US008999331B2

(12) United States Patent
Hsieh et al.

(10) Patent No.: US 8,999,331 B2
(45) Date of Patent: Apr. 7, 2015

(54) IMMUNOBINDERS DIRECTED AGAINST SCLEROSTIN

(71) Applicants: Chung-Ming Hsieh, Newton, MA (US); Alexander Ivanov, Lexington, MA (US); Wendy Waegell, Brookfield, MA (US); Yuliya Kutskova, Northborough, MA (US); John Memmott, Framingham, MA (US); Lorenzo Benatuil, Northborough, MA (US); Jacqueline Bixby, Auburn, MA (US); Emma Fung, Northborough, MA (US); Sahana Bose, Marlborough, MA (US); Alyssa Brito, Hudson, MA (US)

(72) Inventors: Chung-Ming Hsieh, Newton, MA (US); Alexander Ivanov, Lexington, MA (US); Wendy Waegell, Brookfield, MA (US); Yuliya Kutskova, Northborough, MA (US); John Memmott, Framingham, MA (US); Lorenzo Benatuil, Northborough, MA (US); Jacqueline Bixby, Auburn, MA (US); Emma Fung, Northborough, MA (US); Sahana Bose, Marlborough, MA (US); Alyssa Brito, Hudson, MA (US)

(73) Assignee: AbbVie Inc., North Chicago, IL (US)

( * ) Notice: Subject to any disclaimer, the term of this patent is extended or adjusted under 35 U.S.C. 154(b) by 0 days.

(21) Appl. No.: 13/659,647

(22) Filed: Oct. 24, 2012

(65) Prior Publication Data

US 2013/0171096 A1 Jul. 4, 2013

Related U.S. Application Data

(60) Provisional application No. 61/550,724, filed on Oct. 24, 2011.

(51) Int. Cl.
*A61K 39/00* (2006.01)
*A61K 39/395* (2006.01)
*C07K 16/00* (2006.01)
*C07K 16/18* (2006.01)
*C07K 16/22* (2006.01)
*C07K 16/24* (2006.01)
*A61K 31/353* (2006.01)
*A61K 31/439* (2006.01)
*A61K 31/44* (2006.01)
*A61K 31/4439* (2006.01)
*A61K 31/519* (2006.01)
*A61K 31/56* (2006.01)
*A61K 38/13* (2006.01)
*A61K 38/17* (2006.01)
*A61K 38/18* (2006.01)
*A61K 38/19* (2006.01)
*A61K 38/20* (2006.01)
*A61K 38/21* (2006.01)

(52) U.S. Cl.
CPC .............. *C07K 16/18* (2013.01); *C07K 16/22* (2013.01); *C07K 16/241* (2013.01); *A61K 31/353* (2013.01); *A61K 31/439* (2013.01); *A61K 31/44* (2013.01); *A61K 31/4439* (2013.01); *A61K 31/519* (2013.01); *A61K 31/56* (2013.01); *A61K 38/13* (2013.01); *A61K 38/1793* (2013.01); *A61K 38/18* (2013.01); *A61K 38/1808* (2013.01); *A61K 38/1816* (2013.01); *A61K 38/19* (2013.01); *A61K 38/191* (2013.01); *A61K 38/2026* (2013.01); *A61K 38/2066* (2013.01); *A61K 38/2073* (2013.01); *A61K 38/217* (2013.01); *A61K 39/3955* (2013.01); *A61K 2039/505* (2013.01); *C07K 2317/21* (2013.01); *C07K 2317/31* (2013.01); *C07K 2317/565* (2013.01); *C07K 2317/64* (2013.01); *C07K 2317/76* (2013.01); *C07K 2317/90* (2013.01); *C07K 2317/92* (2013.01)

(58) Field of Classification Search
None
See application file for complete search history.

(56) References Cited

U.S. PATENT DOCUMENTS

| 5,624,821 | A | 4/1997 | Winter et al. |
|---|---|---|---|
| 5,648,260 | A | 7/1997 | Winter et al. |
| 7,612,181 | B2 | 11/2009 | Wu et al. |
| 7,744,874 | B2 * | 6/2010 | Korytko et al. ............. 424/130.1 |
| 2006/0024308 | A1 | 2/2006 | Crea et al. |
| 2009/0239259 | A1 | 9/2009 | Hsieh |
| 2009/0311253 | A1 | 12/2009 | Ghayur et al. |
| 2010/0266531 | A1 | 10/2010 | Hsieh et al. |
| 2011/0250130 | A1 | 10/2011 | Benatuil et al. |
| 2012/0034160 | A1 | 2/2012 | Ghayur et al. |
| 2012/0230911 | A1 | 9/2012 | Hsieh et al. |
| 2013/0164256 | A1 | 6/2013 | Hsieh et al. |

FOREIGN PATENT DOCUMENTS

| WO | 9729131 A1 | 8/1997 |
|---|---|---|
| WO | 2004050683 A2 | 6/2004 |

(Continued)

OTHER PUBLICATIONS

Paul, Fundamental Immunology, 1993, Raven Press, NY, pp. 292-295.*

(Continued)

*Primary Examiner* — Elizabeth C Kemmerer
(74) *Attorney, Agent, or Firm* — Lathrop & Gage LLP; James H. Velema, Esq.

(57) ABSTRACT

Proteins that bind sclerostin or sclerostin and TNF are described along with there use in composition and methods for treating, preventing, and diagnosing sclerostin related diseases and for detecting sclerostin or sclerostin and TNF in cells, tissues, samples, and compositions.

17 Claims, 15 Drawing Sheets

(56) References Cited

FOREIGN PATENT DOCUMENTS

| WO | 2005014650 A1 | 2/2005 |
|---|---|---|
| WO | 2006119107 A2 | 11/2006 |
| WO | 2008061013 A2 | 5/2008 |
| WO | 2008115732 A2 | 9/2008 |
| WO | 2008133722 A2 | 11/2008 |
| WO | 2009047356 A1 | 4/2009 |
| WO | 2009091912 A2 | 7/2009 |
| WO | 2009149189 A2 | 12/2009 |
| WO | 2010102251 A2 | 9/2010 |
| WO | 2011059755 A2 | 5/2011 |
| WO | 2011127141 A1 | 10/2011 |
| WO | 2012018790 A2 | 2/2012 |

OTHER PUBLICATIONS

Casset et al. (Biochem Biophys Res Comm. 2003; 307:198-205).*
MacCallum et al. (J Mol Biol. 1996; 262:732-745).*
Vajdos et al. (J Mol Biol. 2002; 320(2):415-428).*
Holm et al. (Mol Immunol. 2007; 44(6):1075-1084).*
Chen et al. (J Mol Biol. 1999; 293:865-881).*
International Search Report and Written Opinion in related application PCT/US2012/061690 mailed Mar. 15, 2013, 20 pages.
International Search Report and Written Opinion in related application PCT/US2012/061666 mailed Mar. 15, 2013, 22 pages.
Lewiecki, Michael: "Sclerostin monoclonal antibody therapy with AMG 785: a potential treatment for osteoporosis", Expert Opinion on Biological Therapy, Informa Healthcare, UK, vol. 11, No. 1, pp. 117-127 (2011).
International Search Report and Written Opinion in related PCT application PCT/US2012/061686, mailed on Mar. 15, 2013, 24 pages.
Nakanishi, et al., Interleukin-18 regulates Both Th1 and Th2 Responses, Ann. Rev. Immunol. 19: 423-74, (2001).
Arndt and Krauss, Bispecific Diabodies for Cancer Therapy, Methods Mol. Biol. 207: 305-21, (2003).
Durocher et al., "High-level and high-throughput recombinant protein production by transient transfection of suspension-growing human 293-EBNA1 cells", Nucleic Acids Res. 30(2), (2002).
Mizushima and Nagata, "pEF-BOS, a powerful mammalian expression vector", Nucleic Acids Res. 18(17), (1990).
Holliger et al., Diabodies: Small bivalent and bispecific antibody fragments, Proc. Natl. Acad. Sci. USA 90:6444-6448; (1993).
Poljak, et al., Production and structure of diabodies, Structure 2:1121-1123, (1994).
Urlaub and Chasin, "Isolation of Chinese hamster cell mutants deficient in dihydrofolate reductase activity," Proc. Natl. Acad. Sci. USA 77:4216-4220, (1980).
Kaufman and Sharp, Amplfication and Expression of Sequences Cotransfected with a Modular Dihydrofolate Reductase Complementary DNA Gene, Mol. Biol. 159:601-621, (1982).
McDonnell, et al., TNF Antagonism, Progress Respir. Res., 31:247-250, (2001).
Harriman G, et al., Summary of clinical trials in rheumatoid arthritis using infliximab, an anti-TNFalpha treatment, Ann. Rheum. Dis., 58 Suppl 1:161-4, (1999).
Peng, Experimental Use of Murine Lupus Models, Methods Mol. Med., 102:227-72, (2004).
Bossers, et al., Analysis of Gene Expression in Parkinson's Disease: Possible Involvement of Neurotrophic Support and Axon Guidance in Dopaminergic Cell Death, Brain Pathol., 19: 91-107, (2009).
McGee et al., "The Nogo-66 receptor: focusing myelin inhibition of axon regeneration", Trends Neurosci., 26:193, (2003).

* cited by examiner

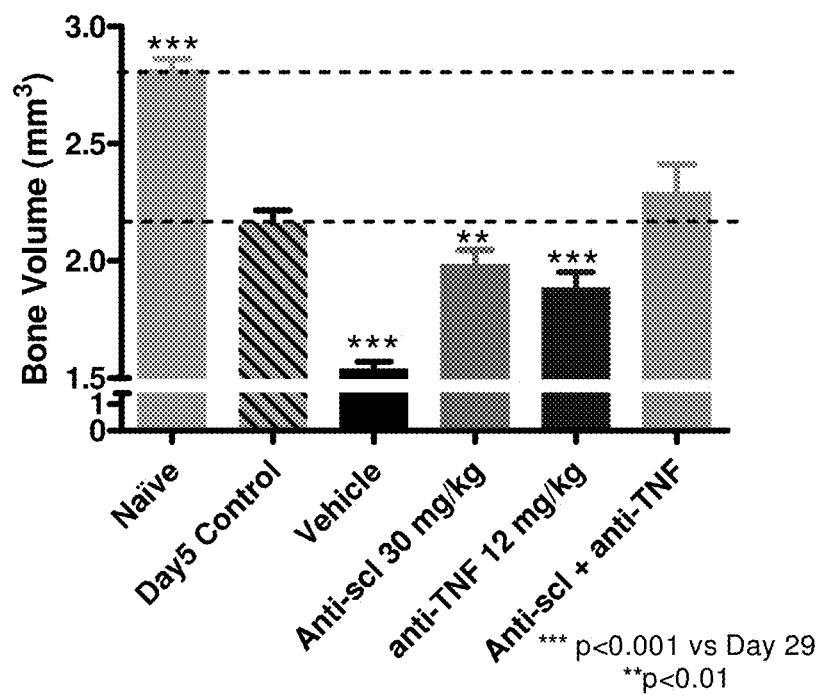

**p<0.01 vs Day 29
***p<0.001 vs Day 29

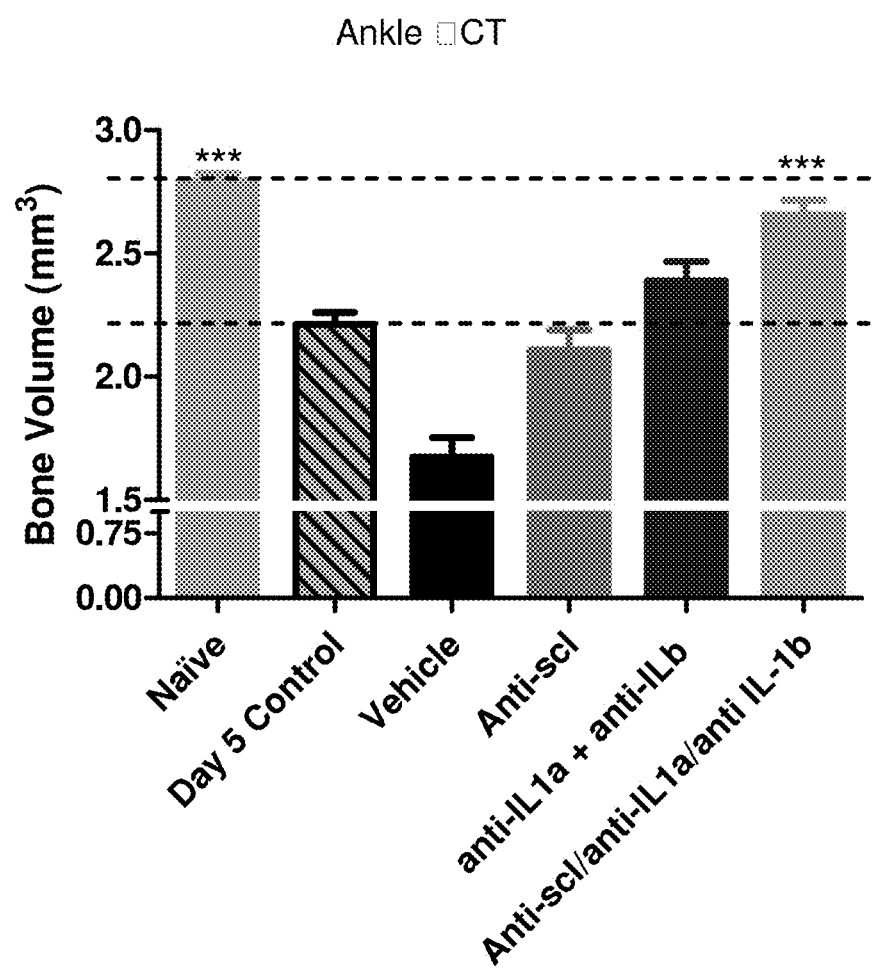

US 8,999,331 B2

IMMUNOBINDERS DIRECTED AGAINST SCLEROSTIN

CROSS-REFERENCE TO RELATED APPLICATIONS

This application claims priority to U.S. Provisional Application Ser. No. 61/550,724, filed Oct. 24, 2011, which is incorporated herein by reference in its entirety.

SEQUENCE LISTING

The instant application contains a Sequence Listing which has been submitted in ASCII format via EFS-Web and is hereby incorporated by reference in its entirety. Said ASCII copy, created on Dec. 19, 2012, is named 532352_Seq_List-.txt and is 2,706,515 bytes in size.

FIELD OF THE INVENTION

Sclerostin binding proteins, and specifically their uses in the prevention and/or treatment of acute and chronic immunological diseases such as rheumatoid arthritis, osteoarthritis, psoriasis, multiple sclerosis, and other autoimmune diseases are provided.

BACKGROUND OF THE INVENTION

The SOST gene encodes a 24 KD protein called sclerostin that has been classified as a member of the DAN family of cysteine knot containing glycoproteins based on sequence similarity (Avasian-Kretchmer (2004) Mol. Endocrinol. 8(1): 1-12). Sclerostin is a negative regulator of bone formation that inhibits osteoblast proliferation as well as differentiation and suppresses mineralization of osteoblastic cells in vitro (Poole et al. (2005) FASEB J. 19:1836-38; Winkler et al. (2005) J. Biol. Chem. 280(4): 2498-2502).

Sclerostin is an inhibitor of the canonical Wnt signaling pathway. It binds to LRP4, LRP5 and/or LRP6 receptors leading to stabilization of β-catenin leading to regulation of gene transcription through transcription regulators including lymphoid enhancing factor-1 (LEF) and T cell factors (TCF). Sclerostin inhibition allows signaling through the Wnt pathway resulting in bone formation (van Bezooijen et al. (2007) J. Bone Min. Res. 22(1):19-28).

An increase in canonical Wnt signaling results in increased bone mass (Li et al. (2005) J. Biol. Chem. 280(20):19883-7; Semenov et al. (2005) J. Biol. Chem. 280(29):26770-775). Loss of function mutants in LRP5 lead to the low bone mass phenotype seen in osteoporosis-pseudoglioma syndrome in humans and LRP5 KO mice demonstrate phenotypes similar to those seen in these patients (Balemans et al. (2008) Calcif. Tissue Int. 82:445-53). Two human mutations of the SOST gene have been identified that lead to Sclerosteosis and Van Buchem's disease, both of which result in a high bone mass phenotype (Brunkow et al. (2001) Am. J. Hum. Genet. 68:577-89; Balemans et al. (2001) Hum Mol Genet. 10:537-43). Additionally, sclerostin KO mice demonstrate a high bone mass phenotype while sclerostin over—producing Tg mice have a low bone mass phenotype (Li et al. (2008) J. Bone and Min. Res. 23(6):860-9).

UCB Celltech (formerly Celltech), in collaboration with AMGEN, is developing a sclerostin neutralizing mAb for the treatment of osteoporosis and fracture healing. Phase I clinical trials have been completed. A Phase II trial has been completed in osteoporosis and Phase III trials have been initiated. Multiple Phase II trials are ongoing for the treatment of fracture healing. The pathogenic role of TNF in arthritis is well established as TNF-α antagonists reduce inflammation and limit progression of cartilage damage and bone erosion in human disease (van den Berg (2001) Arthritis Res. 3:18-26). Although TNF antagonists have revolutionized RA therapy, a significant portion of patients do not respond adequately to these drugs. Preclinical studies with TNF-α and SOST point to both independent and overlapping roles in arthritis pathophysiology. Whereas sclerostin or TNF-α inhibition alone exert only modest effects on proinflammatory gene expression, the combination of SOST inhibition with TNF-α inhibition leads to strong synergistic responses. In particular, the combination of inhibiting sclerostin and TNF-α has the potential to both block inflammation and promote bone healing providing greater clinical benefit to patients.

Although a variety of antibodies to sclerostin have been described since the discovery of this critical proinflammatory cytokine, there remains a need for improved antibodies that can effectively mediate or neutralize the activity of sclerostin during an inflammatory response or autoimmune disorder, while protecting or restoring bone mineral density, bone volume and bone strength.

BRIEF SUMMARY OF THE INVENTION

Proteins that bind human sclerostin are provided. Binding proteins are provided that include but are not limited to antibodies, antigen binding portions thereof, and multivalent, multispecific binding proteins such as DVD-binding proteins that can bind human Sclerostin and another target, such as TNF-α. Methods of making and using the sclerostin binding proteins described herein as well as various compositions that may be used in methods of detecting sclerostin in a sample or in methods of treating or preventing a disorder in an individual that is associated with or suspected to be associated with sclerostin activity are provided.

In one aspect, there is provided a binding protein comprising an antigen binding domain capable of binding human sclerostin, said antigen binding domain comprising at least one CDR comprising:

CDR-H1.
(SEQ ID NO: 15)
$X_1$-$X_2$-$X_3$-$X_4$-$X_5$-$X_6$-$X_7$

CDR-H2.
(SEQ ID NO: 16)
$X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$-$X_{17}$-$X_{18}$

CDR-H3.
(SEQ ID NO: 17)
$X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$-$X_{17}$-$X_{18}$-$X_{19}$-$X_{20}$-$X_{21}$

CDR-L1.
(SEQ ID NO: 18)
$X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$

CDR-L2.
(SEQ ID NO: 19)
$X_1$-$X_2$-$X_3$-$X_4$-$X_5$-$X_6$-$X_7$
or

CDR-L3.
(SEQ ID NO: 20)
$X_1$-$X_2$-$X_3$-$X_4$-$X_5$-$X_6$-$X_7$-$X_8$-$X_9$-$X_{10}$-$X_{11}$-$X_{12}$.

In an embodiment, a binding protein is provided that comprises at least one CDR comprising residues 31-35 of SEQ ID NO: 3; residues 50-66 of SEQ ID NO: 3; residues 99-108 of SEQ ID NO:3; residues 23-34 of SEQ ID NO: 4; residues 51-57 of SEQ ID NO: 4; residues 90-101 of SEQ ID NO:4; residues 31-35 of SEQ ID NO: 5; residues 50-66 of SEQ ID NO: 5; residues 99-115 of SEQ ID NO:5; residues 23-33 of SEQ ID NO: 6; residues 49-55 of SEQ ID NO: 6; residues 88-96 of SEQ ID NO:6; residues 31-35 of SEQ ID NO: 7; residues 50-66 of SEQ ID NO: 7; residues 99-107 of SEQ ID NO:7; residues 23-33 of SEQ ID NO: 8; residues 49-55 of SEQ ID NO: 8; residues 88-95 of SEQ ID NO:8; residues 31-35 of SEQ ID NO: 9; residues 50-66 of SEQ ID NO: 9; residues 99-107 of SEQ ID NO:9; residues 24-39 of SEQ ID NO: 10; residues 55-61 of SEQ ID NO: 10; residues 94-112 of SEQ ID NO:10; residues 31-35 of SEQ ID NO: 11; residues 50-66 of SEQ ID NO: 11; residues 99-111 of SEQ ID NO: 11; residues 24-39 of SEQ ID NO: 12; residues 55-61 of SEQ ID NO: 12; residues 94-113 of SEQ ID NO:12; residues 31-37 of SEQ ID NO: 13; residues 52-69 of SEQ ID NO: 13; residues 102-122 of SEQ ID NO:13; residues 24-34 of SEQ ID NO: 14; residues 50-56 of SEQ ID NO: 14; residues 89-97 of SEQ ID NO:14; Residues 31-35 of SEQ ID NO:1998; Residues 50-66 of SEQ ID NO:1998; Residues 99-110 of SEQ ID NO:1998; Residues 31-35 of SEQ ID NO.:1999; Residues 50-66 of SEQ ID NO.:1999; Residues 99-110 of SEQ ID NO.:1999; Residues 31-35 of SEQ ID NO.:2000; Residues 50-66 of SEQ ID NO.:2000; Residues 99-110 of SEQ ID NO.:2000; Residues 31-35 of SEQ ID NO.:2001; Residues 50-66 of SEQ ID NO.:2001; Residues 99-110 of SEQ ID NO.:2001; Residues 31-35 of SEQ ID NO.:2002; Residues 50-66 of SEQ ID NO.:2002; Residues 99-110 of SEQ ID NO.:2002; Residues 31-35 of SEQ ID NO.:2003; Residues 50-66 of SEQ ID NO.:2003; Residues 99-110 of SEQ ID NO.:2003; Residues 31-35 of SEQ ID NO.:2004; Residues 50-66 of SEQ ID NO.:2004; Residues 99-110 of SEQ ID NO.:2004; Residues 31-35 of SEQ ID NO.:2005; Residues 50-66 of SEQ ID NO.:2005; Residues 99-110 of SEQ ID NO.:2005; Residues 31-35 of SEQ ID NO.:2006; Residues 50-66 of SEQ ID NO.:2006; Residues 99-110 of SEQ ID NO.:2006; Residues 31-35 of SEQ ID NO.:2007; Residues 50-66 of SEQ ID NO.:2007; Residues 99-110 of SEQ ID NO.:2007; Residues 23-36 of SEQ ID NO.:2008; Residues 52-58 of SEQ ID NO.:2008; Residues 91-99 of SEQ ID NO.:2008; Residues 23-36 of SEQ ID NO.:2009; Residues 52-58 of SEQ ID NO.:2009; Residues 91-99 of SEQ ID NO.:2009; Residues 23-36 of SEQ ID NO.:2008; Residues 52-58 of SEQ ID NO.:2010; Residues 91-99 of SEQ ID NO.:2010; Residues 23-36 of SEQ ID NO.:2011; Residues 52-58 of SEQ ID NO.:2011; Residues 91-99 of SEQ ID NO.:2011; Residues 23-36 of SEQ ID NO.:2012; Residues 52-58 of SEQ ID NO.:2012; Residues 91-99 of SEQ ID NO.:2012; Residues 23-36 of SEQ ID NO.:2013; Residues 52-58 of SEQ ID NO.:2013; Residues 91-99 of SEQ ID NO.:2013; Residues 23-36 of SEQ ID NO.:2014; Residues 52-58 of SEQ ID NO.:2014; Residues 91-99 of SEQ ID NO.:2014; Residues 23-36 of SEQ ID NO.:2015; Residues 52-58 of SEQ ID NO.:2015; Residues 91-99 of SEQ ID NO.:2015; Residues 23-36 of SEQ ID NO.:2016; Residues 52-58 of SEQ ID NO.:2016; Residues 91-99 of SEQ ID NO.:2016; Residues 23-36 of SEQ ID NO.:2017; Residues 52-58 of SEQ ID NO.:2017; Residues 91-99 of SEQ ID NO.:2017; Residues 31-35 of SEQ ID NO:2020; Residues 50-66 of SEQ ID NO:2020; Residues 99-108 of SEQ ID NO:2020; Residues 31-35 of SEQ ID NO:2021; Residues 50-66 of SEQ ID NO:2021; Residues 99-108 of SEQ ID NO:2021; Residues 31-35 of SEQ ID NO:2022; Residues 50-66 of SEQ ID NO:2022; Residues 99-108 of SEQ ID NO:2022; Residues 31-35 of SEQ ID NO:2023; Residues 50-66 of SEQ ID NO:2023; Residues 99-108 of SEQ ID NO:2023; Residues 31-35 of SEQ ID NO:2024; Residues 50-66 of SEQ ID NO:2024; Residues 99-108 of SEQ ID NO:2024; Residues 31-35 of SEQ ID NO:2025; Residues 50-66 of SEQ ID NO:2025; Residues 99-108 of SEQ ID NO:2025; Residues 31-35 of SEQ ID NO:2026; Residues 50-66 of SEQ ID NO:2026; Residues 99-108 of SEQ ID NO:2026; Residues 31-35 of SEQ ID NO:2027; Residues 50-66 of SEQ ID NO:2027; Residues 99-108 of SEQ ID NO:2027; Residues 31-35 of SEQ ID NO:2028; Residues 50-66 of SEQ ID NO:2028; Residues 99-108 of SEQ ID NO:2028; Residues 31-35 of SEQ ID NO:2029; Residues 50-66 of SEQ ID NO:2029; Residues 99-108 of SEQ ID NO:2029; Residues 31-35 of SEQ ID NO:2030; Residues 50-66 of SEQ ID NO:2030; Residues 99-108 of SEQ ID NO:2030; Residues 31-35 of SEQ ID NO:2031; Residues 50-66 of SEQ ID NO:2031; Residues 99-108 of SEQ ID NO:2031; Residues 31-35 of SEQ ID NO:2032; Residues 50-66 of SEQ ID NO:2032; Residues 99-108 of SEQ ID NO:2032; Residues 31-35 of SEQ ID NO:2033; Residues 50-66 of SEQ ID NO:2033; Residues 99-108 of SEQ ID NO:2033; Residues 31-35 of SEQ ID NO:2034; Residues 50-66 of SEQ ID NO:2034; Residues 99-110 of SEQ ID NO:2034; Residues 31-35 of SEQ ID NO.:2035; Residues 51-57 of SEQ ID NO.:2035; Residues 90-101 of SEQ ID NO.:2035; Residues 31-35 of SEQ ID NO.:2036; Residues 51-57 of SEQ ID NO.:2036; Residues 90-101 of SEQ ID NO.:2036; Residues 31-35 of SEQ ID NO.:2037; Residues 51-57 of SEQ ID NO.:2035; Residues 90-101 of SEQ ID NO.:2037; Residues 31-35 of SEQ ID NO.:2038; Residues 51-57 of SEQ ID NO.:2038; Residues 90-101 of SEQ ID NO.:2038; Residues 31-35 of SEQ ID NO.:2039; Residues 51-57 of SEQ ID NO.:2039; Residues 90-101 of SEQ ID NO.:2039; Residues 31-35 of SEQ ID NO.:2040; Residues 51-57 of SEQ ID NO.:2040; Residues 90-101 of SEQ ID NO.:2040; Residues 31-35 of SEQ ID NO.:2041; Residues 51-57 of SEQ ID NO.:2041; Residues 90-101 of SEQ ID NO.:2041; Residues 31-35 of SEQ ID NO.:2042; Residues 51-57 of SEQ ID NO.:2042; Residues 90-101 of SEQ ID NO.:2042; Residues 31-35 of SEQ ID NO.:2043; Residues 51-57 of SEQ ID NO.:2043; Residues 90-101 of SEQ ID NO.:2043; Residues 31-35 of SEQ ID NO.:2044; Residues 51-57 of SEQ ID NO.:2044; Residues 90-101 of SEQ ID NO.:2044; Residues 31-35 of SEQ ID NO.:2045; Residues 51-57 of SEQ ID NO.:2045; Residues 90-101 of SEQ ID NO.:2045; Residues 31-35 of SEQ ID NO.:2046; Residues 51-57 of SEQ ID NO.:2046; Residues 90-101 of SEQ ID NO.:2046; Residues 31-35 of SEQ ID NO.:2047; Residues 51-57 of SEQ ID NO.:2047; Residues 90-101 of SEQ ID NO.:2047; Residues 31-35 of SEQ ID NO.:2048; Residues 51-57 of SEQ ID NO.:2048; Residues 90-101 of SEQ ID NO.:2048; Residues 31-35 of SEQ ID NO.:2049; Residues 51-57 of SEQ ID NO.:2049; and Residues 90-101 of SEQ ID NO.:2049.

In another embodiment, a sclerostin binding protein comprising at least 3 CDRs described above is provided.

In another embodiment, a sclerostin binding protein is provided that comprises at least 3 CDRs of Table 1:

TABLE 1

| VH MSL10 CDR Set | |
|---|---|
| VH MSL10 CDR-H1 | Residues 31-35 of SEQ ID NO: 3 |
| VH MSL10 CDR-H2 | Residues 50-66 of SEQ ID NO: 3 |
| VH MSL10 CDR-H3 | Residues 99-108 of SEQ ID NO: 3 |

TABLE 1-continued

VL MSL10 CDR Set

| | |
|---|---|
| VL MSL10 CDR-L1 | Residues 23-34 of SEQ ID NO: 4 |
| VL MSL10 CDR-L2 | Residues 51-57 of SEQ ID NO: 4 |
| VL MSL10 CDR-L3 | Residues 90-101 of SEQ ID NO: 4 |

VH MSL10 AM1 CDR Set

| | |
|---|---|
| VH MSL10 AM1 CDR-H1 | Residues 31-35 of SEQ ID NO: 2020 |
| VH MSL10 AM1 CDR-H2 | Residues 50-66 of SEQ ID NO: 2020 |
| VH MSL10 AM1 CDR-H3 | Residues 99-108 of SEQ ID NO: 2020 |

VL MSL10 AM1 CDR Set

| | |
|---|---|
| VL MSL10 AM1 CDR-L1 | Residues 23-34 of SEQ ID NO: 2035 |
| VL MSL10 AM1 CDR-L2 | Residues 51-57 of SEQ ID NO: 2035 |
| VL MSL10 AM1 CDR-L3 | Residues 90-101 of SEQ ID NO: 2035 |

VH MSL10 AM2 CDR Set

| | |
|---|---|
| VH MSL10 AM2 CDR-H1 | Residues 31-35 of SEQ ID NO: 2021 |
| VH MSL10 AM2 CDR-H2 | Residues 50-66 of SEQ ID NO: 2021 |
| VH MSL10 AM2 CDR-H3 | Residues 99-108 of SEQ ID NO: 2021 |

VL MSL10 AM2 CDR Set

| | |
|---|---|
| VL MSL10 AM2 CDR-L1 | Residues 23-34 of SEQ ID NO: 2036 |
| VL MSL10 AM2 CDR-L2 | Residues 51-57 of SEQ ID NO: 2036 |
| VL MSL10 AM2 CDR-L3 | Residues 90-101 of SEQ ID NO: 2036 |

VH MSL10 AM3 CDR Set

| | |
|---|---|
| VH MSL10 AM3 CDR-H1 | Residues 31-35 of SEQ ID NO: 2022 |
| VH MSL10 AM3 CDR-H2 | Residues 50-66 of SEQ ID NO: 2022 |
| VH MSL10 AM3 CDR-H3 | Residues 99-108 of SEQ ID NO: 2022 |

VL MSL10 AM3 CDR Set

| | |
|---|---|
| VL MSL10 AM3 CDR-L1 | Residues 23-34 of SEQ ID NO: 2037 |
| VL MSL10 AM3 CDR-L2 | Residues 51-57 of SEQ ID NO: 2037 |
| VL MSL10 AM3 CDR-L3 | Residues 90-101 of SEQ ID NO: 2037 |

VH MSL10 AM4 CDR Set

| | |
|---|---|
| VH MSL10 AM4 CDR-H1 | Residues 31-35 of SEQ ID NO: 2023 |
| VH MSL10 AM4 CDR-H2 | Residues 50-66 of SEQ ID NO: 2023 |
| VH MSL10 AM4 CDR-H3 | Residues 99-108 of SEQ ID NO: 2023 |

VL MSL10 AM4 CDR Set

| | |
|---|---|
| VL MSL10 AM4 CDR-L1 | Residues 23-34 of SEQ ID NO: 2038 |
| VL MSL10 AM4 CDR-L2 | Residues 51-57 of SEQ ID NO: 2038 |
| VL MSL10 AM4 CDR-L3 | Residues 90-101 of SEQ ID NO: 2038 |

VH MSL10 AM5 CDR Set

| | |
|---|---|
| VH MSL10 AM5 CDR-H1 | Residues 31-35 of SEQ ID NO: 2024 |
| VH MSL10 AM5 CDR-H2 | Residues 50-66 of SEQ ID NO: 2024 |
| VH MSL10 AM5 CDR-H3 | Residues 99-108 of SEQ ID NO: 2024 |

VL MSL10 AM5 CDR Set

| | |
|---|---|
| VL MSL10 AM5 CDR-L1 | Residues 23-34 of SEQ ID NO: 2039 |
| VL MSL10 AM5 CDR-L2 | Residues 51-57 of SEQ ID NO: 2039 |
| VL MSL10 AM5 CDR-L3 | Residues 90-101 of SEQ ID NO: 2039 |

VH MSL10 AM6 CDR Set

| | |
|---|---|
| VH MSL10 AM6 CDR-H1 | Residues 31-35 of SEQ ID NO: 2025 |
| VH MSL10 AM6 CDR-H2 | Residues 50-66 of SEQ ID NO: 2025 |
| VH MSL10 AM6 CDR-H3 | Residues 99-108 of SEQ ID NO: 2025 |

VL MSL10 AM6 CDR Set

| | |
|---|---|
| VL MSL10 AM6 CDR-L1 | Residues 23-34 of SEQ ID NO: 2040 |
| VL MSL10 AM6 CDR-L2 | Residues 51-57 of SEQ ID NO: 2040 |
| VL MSL10 AM6 CDR-L3 | Residues 90-101 of SEQ ID NO: 2040 |

VH MSL10 AM7 CDR Set

| | |
|---|---|
| VH MSL10 AM7 CDR-H1 | Residues 31-35 of SEQ ID NO: 2026 |
| VH MSL10 AM7 CDR-H2 | Residues 50-66 of SEQ ID NO: 2026 |
| VH MSL10 AM7 CDR-H3 | Residues 99-108 of SEQ ID NO: 2026 |

VL MSL10 AM7 CDR Set

| | |
|---|---|
| VL MSL10 AM7 CDR-L1 | Residues 23-34 of SEQ ID NO: 2041 |
| VL MSL10 AM7 CDR-L2 | Residues 51-57 of SEQ ID NO: 2041 |
| VL MSL10 AM7 CDR-L3 | Residues 90-101 of SEQ ID NO: 2041 |

VH MSL10 AM8 CDR Set

| | |
|---|---|
| VH MSL10 AM8 CDR-H1 | Residues 31-35 of SEQ ID NO: 2027 |
| VH MSL10 AM8 CDR-H2 | Residues 50-66 of SEQ ID NO: 2027 |
| VH MSL10 AM8 CDR-H3 | Residues 99-108 of SEQ ID NO: 2027 |

VL MSL10 AM8 CDR Set

| | |
|---|---|
| VL MSL10 AM8 CDR-L1 | Residues 23-34 of SEQ ID NO: 2042 |
| VL MSL10 AM8 CDR-L2 | Residues 51-57 of SEQ ID NO: 2042 |
| VL MSL10 AM8 CDR-L3 | Residues 90-101 of SEQ ID NO: 2042 |

VH MSL10 AM9 CDR Set

| | |
|---|---|
| VH MSL10 AM9 CDR-H1 | Residues 31-35 of SEQ ID NO: 2028 |
| VH MSL10 AM9 CDR-H2 | Residues 50-66 of SEQ ID NO: 2028 |
| VH MSL10 AM9 CDR-H3 | Residues 99-108 of SEQ ID NO: 2028 |

VL MSL10 AM9 CDR Set

| | |
|---|---|
| VL MSL10 AM9 CDR-L1 | Residues 23-34 of SEQ ID NO: 2043 |
| VL MSL10 AM9 CDR-L2 | Residues 51-57 of SEQ ID NO: 2043 |
| VL MSL10 AM9 CDR-L3 | Residues 90-101 of SEQ ID NO: 2043 |

VH MSL10 AM10 CDR Set

| | |
|---|---|
| VH MSL10 AM10 CDR-H1 | Residues 31-35 of SEQ ID NO: 2029 |
| VH MSL10 AM10 CDR-H2 | Residues 50-66 of SEQ ID NO: 2029 |
| VH MSL10 AM10 CDR-H3 | Residues 99-108 of SEQ ID NO: 2029 |

VL MSL10 AM10 CDR Set

| | |
|---|---|
| VL MSL10 AM10 CDR-L1 | Residues 23-34 of SEQ ID NO: 2044 |
| VL MSL10 AM10 CDR-L2 | Residues 51-57 of SEQ ID NO: 2044 |
| VL MSL10 AM10 CDR-L3 | Residues 90-101 of SEQ ID NO: 2044 |

VH MSL10 AM11 CDR Set

| | |
|---|---|
| VH MSL10 AM11 CDR-H1 | Residues 31-35 of SEQ ID NO: 2030 |
| VH MSL10 AM11 CDR-H2 | Residues 50-66 of SEQ ID NO: 2030 |
| VH MSL10 AM11 CDR-H3 | Residues 99-108 of SEQ ID NO: 2030 |

VL MSL10 AM10 CDR Set

| | |
|---|---|
| VL MSL10 AM11 CDR-L1 | Residues 23-34 of SEQ ID NO: 2045 |
| VL MSL10 AM11 CDR-L2 | Residues 51-57 of SEQ ID NO: 2045 |
| VL MSL10 AM11 CDR-L3 | Residues 90-101 of SEQ ID NO: 2045 |

VH MSL10 AM1.2 CDR Set

| | |
|---|---|
| VH MSL10 AM1.2 CDR-H1 | Residues 31-35 of SEQ ID NO: 2031 |
| VH MSL10 AM1.2 CDR-H2 | Residues 50-66 of SEQ ID NO: 2031 |
| VH MSL10 AM1.2 CDR-H3 | Residues 99-108 of SEQ ID NO: 2031 |

VL MSL10 AM1.2 CDR Set

| | |
|---|---|
| VL MSL10 AM1.2 CDR-L1 | Residues 23-34 of SEQ ID NO: 2046 |
| VL MSL10 AM1.2 CDR-L2 | Residues 51-57 of SEQ ID NO: 2046 |
| VL MSL10 AM1.2 CDR-L3 | Residues 90-101 of SEQ ID NO: 2046 |

VH MSL10 AM2.2 CDR Set

| | |
|---|---|
| VH MSL10 AM2.2 CDR-H1 | Residues 31-35 of SEQ ID NO: 2032 |
| VH MSL10 AM2.2 CDR-H2 | Residues 50-66 of SEQ ID NO: 2032 |
| VH MSL10 AM2.2 CDR-H3 | Residues 99-108 of SEQ ID NO: 2032 |

VL MSL10 AM2.2 CDR Set

| | |
|---|---|
| VL MSL10 AM2.2 CDR-L1 | Residues 23-34 of SEQ ID NO: 2047 |
| VL MSL10 AM2.2 CDR-L2 | Residues 51-57 of SEQ ID NO: 2047 |
| VL MSL10 AM2.2 CDR-L3 | Residues 90-101 of SEQ ID NO: 2047 |

VH MSL10 AM3.2 CDR Set

| | |
|---|---|
| VH MSL10 AM3.2 CDR-H1 | Residues 31-35 of SEQ ID NO: 2033 |
| VH MSL10 AM3.2 CDR-H2 | Residues 50-66 of SEQ ID NO: 2033 |
| VH MSL10 AM3.2 CDR-H3 | Residues 99-108 of SEQ ID NO: 2033 |

VL MSL10 AM3.2 CDR Set

| | |
|---|---|
| VL MSL10 AM3.2 CDR-L1 | Residues 23-34 of SEQ ID NO: 2048 |
| VL MSL10 AM3.2 CDR-L2 | Residues 51-57 of SEQ ID NO: 2048 |
| VL MSL10 AM3.2 CDR-L3 | Residues 90-101 of SEQ ID NO: 2048 |

VH MSL10 AM4.2 CDR Set

| | |
|---|---|
| VH MSL10 AM4.2 CDR-H1 | Residues 31-35 of SEQ ID NO: 2034 |
| VH MSL10 AM4.2 CDR-H2 | Residues 50-66 of SEQ ID NO: 2034 |
| VH MSL10 AM4.2 CDR-H3 | Residues 99-108 of SEQ ID NO: 2034 |

VL MSL10 AM4.2 CDR Set

| | |
|---|---|
| VL MSL10 AM4.2 CDR-L1 | Residues 23-34 of SEQ ID NO: 2049 |
| VL MSL10 AM4.2 CDR-L2 | Residues 51-57 of SEQ ID NO: 2049 |
| VL MSL10 AM4.2 CDR-L3 | Residues 90-101 of SEQ ID NO: 2049 |

VH MSL17 CDR Set

| | |
|---|---|
| VH MSL17 CDR-H1 | Residues 31-35 of SEQ ID NO: 5 |
| VH MSL17 CDR-H2 | Residues 50-66 of SEQ ID NO: 5 |
| VH MSL17 CDR-H3 | Residues 99-115 of SEQ ID NO: 5 |

TABLE 1-continued

VL MSL17 CDR Set

| | |
|---|---|
| VL MSL17 CDR-L1 | Residues 23-33 of SEQ ID NO: 6 |
| VL MSL17 CDR-L2 | Residues 49-55 of SEQ ID NO: 6 |
| VL MSL17 CDR-L3 | Residues 88-96 of SEQ ID NO: 6 |

VH MSL9-8 CDR Set

| | |
|---|---|
| VH MSL9-8 CDR-H1 | Residues 31-35 of SEQ ID NO: 7 |
| VH MSL9-8 CDR-H2 | Residues 50-66 of SEQ ID NO: 7 |
| VH MSL9-8 CDR-H3 | Residues 99-107 of SEQ ID NO: 7 |

VL MSL9-8 CDR Set

| | |
|---|---|
| VL MSL9-8 CDR-L1 | Residues 23-33 of SEQ ID NO: 8 |
| VL MSL9-8 CDR-L2 | Residues 49-55 of SEQ ID NO: 8 |
| VL MSL9-8 CDR-L3 | Residues 88-95 of SEQ ID NO: 8 |

VH MSK9 CDR Set

| | |
|---|---|
| VH MSK9 CDR-H1 | Residues 31-35 of SEQ ID NO: 9 |
| VH MSK9 CDR-H2 | Residues 50-66 of SEQ ID NO: 9 |
| VH MSK9 CDR-H3 | Residues 99-107 of SEQ ID NO: 9 |

VL MSK9 CDR Set

| | |
|---|---|
| VL MSK9 CDR-L1 | Residues 24-39 of SEQ ID NO: 10 |
| VL MSK9 CDR-L2 | Residues 55-61 of SEQ ID NO: 10 |
| VL MSK9 CDR-L3 | Residues 94-112 of SEQ ID NO: 10 |

VH MSK13 CDR Set

| | |
|---|---|
| VH MSK13 CDR-H1 | Residues 31-35 of SEQ ID NO: 11 |
| VH MSK13 CDR-H2 | Residues 50-66 of SEQ ID NO: 11 |
| VH MSK13 CDR-H3 | Residues 99-111 of SEQ ID NO: 11 |

VL MSK13 CDR Set

| | |
|---|---|
| VL MSK13 CDR-L1 | Residues 24-39 of SEQ ID NO: 12 |
| VL MSK13 CDR-L2 | Residues 55-61 of SEQ ID NO: 12 |
| VL MSK13 CDR-L3 | Residues 94-113 of SEQ ID NO: 12 |

VH MSK21 CDR Set

| | |
|---|---|
| VH MSK21 CDR-H1 | Residues 31-35 of SEQ ID NO: 13 |
| VH MSK21 CDR-H2 | Residues 50-66 of SEQ ID NO: 13 |
| VH MSK21 CDR-H3 | Residues 99-110 of SEQ ID NO: 13 |

VL MSK21 CDR Set

| | |
|---|---|
| VL MSK21 CDR-L1 | Residues 23-36 of SEQ ID NO: 14 |
| VL MSK21 CDR-L2 | Residues 52-58 of SEQ ID NO: 14 |
| VL MSK21 CDR-L3 | Residues 91-99 of SEQ ID NO: 14 |

VH AE10-6 AM1 CDR Set

| | |
|---|---|
| VH AE10-6 AM1 CDR-H1 | Residues 31-35 of SEQ ID NO: 1998 |
| VH AE10-6 AM1 CDR-H2 | Residues 50-66 of SEQ ID NO: 1998 |
| VH AE10-6 AM1 CDR-H3 | Residue 99-110 of SEQ ID NO: 1998 |

VL AE10-6 AM1 Set

| | |
|---|---|
| VL AE10-6 AM1 CDR-L1 | Residues 23-36 of SEQ ID NO: 2008 |
| VL AE10-6 AM1 CDR-L2 | Residues 52-58 of SEQ ID NO: 2008 |
| VL AE10-6 AM1 CDR-L3 | Residues 91-99 of SEQ ID NO: 2008 |

VH AE10-6 AM2 CDR Set

| | |
|---|---|
| VH AE10-6 AM2 CDR-H1 | Residues 31-35 of SEQ ID NO: 1999 |
| VH AE10-6 AM2 CDR-H2 | Residues 50-66 of SEQ ID NO: 1999 |
| VH AE10-6 AM2 CDR-H3 | Residue 99-110 of SEQ ID NO: 1999 |

VL AE10-6 AM2 Set

| | |
|---|---|
| VL AE10-6 AM2 CDR-L1 | Residues 23-36 of SEQ ID NO: 2009 |
| VL AE10-6 AM2 CDR-L2 | Residues 52-58 of SEQ ID NO: 2009 |
| VL AE10-6 AM2 CDR-L3 | Residues 91-99 of SEQ ID NO: 2009 |

VH AE10-6 AM3 CDR Set

| | |
|---|---|
| VH AE10-6 AM3 CDR-H1 | Residues 31-35 of SEQ ID NO: 2000 |
| VH AE10-6 AM3 CDR-H2 | Residues 50-66 of SEQ ID NO: 2000 |
| VH AE10-6 AM3 CDR-H3 | Residue 99-110 of SEQ ID NO: 2000 |

VL AE10-6 AM3 Set

| | |
|---|---|
| VL AE10-6 AM3 CDR-L1 | Residues 23-36 of SEQ ID NO: 2010 |
| VL AE10-6 AM3 CDR-L2 | Residues 52-58 of SEQ ID NO: 2010 |
| VL AE10-6 AM3 CDR-L3 | Residues 91-99 of SEQ ID NO: 2010 |

VH AE10-6 AM4 CDR Set

| | |
|---|---|
| VH AE10-6 AM4 CDR-H1 | Residues 31-35 of SEQ ID NO: 2001 |
| VH AE10-6 AM4 CDR-H2 | Residues 50-66 of SEQ ID NO: 2001 |
| VH AE10-6 AM4 CDR-H3 | Residue 99-110 of SEQ ID NO: 2001 |

VL AE10-6 AM4 Set

| | |
|---|---|
| VL AE10-6 AM4 CDR-L1 | Residues 23-36 of SEQ ID NO: 2011 |
| VL AE10-6 AM4 CDR-L2 | Residues 52-58 of SEQ ID NO: 2011 |
| VL AE10-6 AM4 CDR-L3 | Residues 91-99 of SEQ ID NO: 2011 |

VH AE10-6 AM5 CDR Set

| | |
|---|---|
| VH AE10-6 AM5 CDR-H1 | Residues 31-35 of SEQ ID NO: 2002 |
| VH AE10-6 AM5 CDR-H2 | Residues 50-66 of SEQ ID NO: 2002 |
| VH AE10-6 AM5 CDR-H3 | Residue 99-110 of SEQ ID NO: 2002 |

VL AE10-6 AM5 Set

| | |
|---|---|
| VL AE10-6 AM5 CDR-L1 | Residues 23-36 of SEQ ID NO: 2012 |
| VL AE10-6 AM5 CDR-L2 | Residues 50-66 of SEQ ID NO: 2012 |
| VL AE10-6 AM5 CDR-L3 | Residues 91-99 of SEQ ID NO: 2012 |

VH AE10-6 AM6 CDR Set

| | |
|---|---|
| VH AE10-6 AM6 CDR-H1 | Residues 31-35 of SEQ ID NO: 2003 |
| VH AE10-6 AM6 CDR-H2 | Residues 50-66 of SEQ ID NO: 2003 |
| VH AE10-6 AM6 CDR-H3 | Residue 99-110 of SEQ ID NO: 2003 |

VL AE10-6 AM6 Set

| | |
|---|---|
| VL AE10-6 AM6 CDR-L1 | Residues 23-36 of SEQ ID NO: 2013 |
| VL AE10-6 AM6 CDR-L2 | Residues 52-58 of SEQ ID NO: 2013 |
| VL AE10-6 AM6 CDR-L3 | Residues 91-99 of SEQ ID NO: 2013 |

VH AE10-6 AM7 CDR Set

| | |
|---|---|
| VH AE10-6 AM7 CDR-H1 | Residues 31-35 of SEQ ID NO: 2004 |
| VH AE10-6 AM7 CDR-H2 | Residues 50-66 of SEQ ID NO: 2004 |
| VH AE10-6 AM7 CDR-H3 | Residue 99-110 of SEQ ID NO: 2004 |

VL AE10-6 AM7 Set

| | |
|---|---|
| VL AE10-6 AM7 CDR-L1 | Residues 23-36 of SEQ ID NO: 2014 |
| VL AE10-6 AM7 CDR-L2 | Residues 52-58 of SEQ ID NO: 2014 |
| VL AE10-6 AM7 CDR-L3 | Residues 91-99 of SEQ ID NO: 2014 |

VH AE10-6 AM8 CDR Set

| | |
|---|---|
| VH AE10-6 AM8 CDR-H1 | Residues 31-35 of SEQ ID NO: 2005 |
| VH AE10-6 AM8 CDR-H2 | Residues 50-66 of SEQ ID NO: 2005 |
| VH AE10-6 AM8 CDR-H3 | Residue 99-110 of SEQ ID NO: 2005 |

VL AE10-6 AM8 Set

| | |
|---|---|
| VL AE10-6 AM8 CDR-L1 | Residues 23-36 of SEQ ID NO: 2015 |
| VL AE10-6 AM8 CDR-L2 | Residues 52-58 of SEQ ID NO: 2015 |
| VL AE10-6 AM8 CDR-L3 | Residues 91-99 of SEQ ID NO: 2015 |

VH AE10-6 AM9 CDR Set

| | |
|---|---|
| VH AE10-6 AM9 CDR-H1 | Residues 31-35 of SEQ ID NO: 2006 |
| VH AE10-6 AM9 CDR-H2 | Residues 50-66 of SEQ ID NO: 2006 |
| VH AE10-6 AM9 CDR-H3 | Residue 99-110 of SEQ ID NO: 2006 |

VL AE10-6 AM9 Set

| | |
|---|---|
| VL AE10-6 AM9 CDR-L1 | Residues 23-36 of SEQ ID NO: 2016 |
| VL AE10-6 AM9 CDR-L2 | Residues 52-58 of SEQ ID NO: 2016 |
| VL AE10-6 AM9 CDR-L3 | Residues 91-99 of SEQ ID NO: 2016 |

VH AE10-6 AM10 CDR Set

| | |
|---|---|
| VH AE10-6 AM10 CDR-H1 | Residues 31-35 of SEQ ID NO: 2007 |
| VH AE10-6 AM10 CDR-H2 | Residues 50-66 of SEQ ID NO: 2007 |
| VH AE10-6 AM10 CDR-H3 | Residue 99-110 of SEQ ID NO: 2007 |

VL AE10-6 AM10 Set

| | |
|---|---|
| VL AE10-6 AM10 CDR-L1 | Residues 23-36 of SEQ ID NO: 2017 |
| VL AE10-6 AM10 CDR-L2 | Residues 52-58 of SEQ ID NO: 2017 |
| VL AE10-6 AM10 CDR-L3 | Residues 91-99 of SEQ ID NO: 2017 |

In another embodiment, a sclerostin binding protein may comprise at least two variable domain CDR sets described above. In an embodiment, the two variable domain CDR sets are VH MSL10 CDR Set and VL MSL10 CDR Set; VH MSL17 CDR Set and VL MSL17 CDR Set; VH MSL9-8 CDR Set and VL MSL9-8 CDR Set; VH MSK9 CDR Set and VL MSK9 CDR Set; VH MSK13 CDR Set and VL MSK13 CDR Set; VH MSK21 CDR Set or VL MSK21 CDR Set; VH AE10-6 AM1 CDR Set and VL AE10-6 AM1 CDR Set; VH AE10-6 AM2 CDR Set and VL AE10-6 AM2 CDR Set; VH AE10-6 AM3 CDR Set and VL AE10-6 AM3 CDR Set; VH AE10-6 AM4 CDR Set and VL AE10-6 AM4 CDR Set; VH AE10-6 AM5 CDR Set and VL AE10-6 AM5 CDR Set; VH AE10-6 AM6 CDR Set and VL AE10-6 AM6 CDR Set; VH AE10-6 AM7 CDR Set and VL AE10-6 AM7 CDR Set; VH AE10-6 AM8 CDR Set and VL AE10-6 AM8CDR Set; VH AE10-6 AM9CDR Set and VL AE10-6 AM9CDR Set; VH AE10-6 AM10CDR Set and VL AE10-6 AM10 CDR Set; VH MSL10 AM1 CDR Set and VL MSL10 AM1 CDR Set; VH MSL10 AM2 CDR Set and VL MSL10 AM2 CDR Set; VH MSL10 AM3 CDR Set and VL MSL10 AM3 CDR Set; VH MSL10 AM4 CDR Set and VL MSL10 AM4 CDR Set; VH MSL10 AM5 CDR Set and VL MSL10 AM5 CDR Set; VH MSL10 AM6 CDR Set and VL MSL10 AM6 CDR Set; VH MSL10 AM7 CDR Set and VL MSL10 AM7 CDR Set; VH MSL10 AM8 CDR Set and VL MSL10 AM8 CDR Set; VH MSL10 AM9 CDR Set and VL MSL10 AM9 CDR Set; VH MSL10 AM10 CDR Set and VL MSL10 AM10 CDR Set; VH MSL10 AM1.2 CDR Set and VL MSL10 AM1.2 CDR Set; VH MSL10 AM2.2 CDR Set and VL MSL10 AM2.2 CDR Set; VH MSL10 AM3.2 CDR Set and VL MSL10 AM3.2 CDR Set; and VH MSL10 AM4.2 CDR Set and VL MSL10 AM4.2 CDR Set.

In another embodiment, a sclerostinbinding protein described herein comprises two variable domains, wherein first variable domain comprises a sequence selected from the group consisting of SEQ ID NOs 3, 5, 7, 9, 11, 13, 1719-1866, 1998-2007, 2018, and 2020-2034 and wherein the second variable domain comprises a sequence selected from the group consisting of SEQ ID NOs 4, 6, 8, 10, 12, 1867-1997, 2007-2017, 2019, and 2035-2049.

In another embodiment, a sclerostinbinding protein comprising an antigen binding domain that comprises a $V_H$ is provided. In an embodiment, the $V_H$ comprises any one of SEQ ID NOs 3, 5, 7, 9, 11, 13, 1719-1866, 1998-2007, 2018, or 2020-2034. In another embodiment, the sclerostinbinding protein comprising an antigen binding domain that comprises a $V_L$ is provided. In an embodiment, the $V_L$ comprises any one of SEQ ID NOs 4, 6, 8, 10, 12, 14, 1867-1997, 2008-2017, 2019, or 2035-2049.

In another embodiment, the sclerostin binding protein comprising an antigen binding domain that comprises a $V_H$ and a $V_L$ is provided. In an embodiment, the $V_H$ comprises SEQ ID NO: 3, 5, 7, 9, 11, or 13 and the $V_L$ comprises SEQ ID NO: 4, 6, 8, 10, 12, 14, 1867-1997, 2008-2017, 2019, or 2035-2049.

An sclerostinbinding protein may comprise an alternative human acceptor framework comprising at least one framework region amino acid substitution, wherein the amino acid sequence of the framework is at least 65% identical to the sequence of said human acceptor framework and comprises at least 70 amino acid residues identical to said human acceptor framework.

In another embodiment, an sclerostin binding protein comprises an alternative human acceptor framework, wherein said acceptor framework comprises at least one framework region amino acid substitution at a key residue, said key residue comprising:
  a residue adjacent to a CDR;
  a glycosylation site residue;
  a rare residue;
  a residue capable of interacting with human SOST;
  a residue capable of interacting with a CDR;
  a canonical residue;
  a contact residue between heavy chain variable region and light chain variable region;
  a residue within a Vernier zone; or
  a residue in a region that overlaps between a Chothia-defined variable heavy chain CDR1 and a Kabat-defined first heavy chain framework.

In another embodiment, a sclerostin binding protein described herein, further comprises a heavy chain immunoglobulin constant domain of: a human IgM constant domain; a human IgG1 constant domain; a human IgG2 constant domain; a human IgG3 constant domain; a human IgG4 constant domain; a human IgE constant domain; or a human IgA constant domain. In an embodiment, the heavy chain immunoglobulin constant region is a human IgG1 constant domain. In an embodiment, the human IgG1 constant domain comprises SEQ ID NO: 2060, SEQ ID NO: 2061, SEQ ID NO:2062 or SEQ ID NO:2063.

In another embodiment, a Sclerostin binding protein described herein comprises a light chain immunoglobulin constant domain is a human Ig kappa constant domain or a human Ig lambda constant domain. An exemplary human Ig kappa constant domain comprises amino acid sequence SEQ ID NO:2064. An exemplary human Ig lambda constant domain comprises amino acid sequence SEQ ID NO:2065.

In another embodiment, a sclerostinbinding protein described herein is an immunoglobulin molecule; an scFv; a monoclonal antibody; a human antibody; a chimeric antibody; a humanized antibody; a single domain antibody; an Fab fragment; an Fab' fragment; an F(ab')2; an Fv; or a disulfide linked Fv. In a particular embodiment, the sclerostin binding protein is a human antibody.

Another aspect provides a binding protein capable of binding human sclerostin, wherein the binding protein comprises:
  an Ig constant heavy region having an amino acid sequence of SEQ ID NO: 2060, SEQ ID NO:2061, SEQ ID NO:2062 or SEQ ID NO:2063;
  an Ig constant light region having an amino acid sequence of SEQ ID NO:2064 or SEQ ID NO:2065;
  an Ig variable heavy region having an amino acid sequence of SEQ ID NO:3, 5, 7, 9, 11, 13, 1719-1866, 1998-2007, 2018, or 2020-2034; and
  an Ig variable light region having an amino acid sequence of SEQ ID NO:4, 6, 8, 10, 12, 14, 1867-1997, 2008-2017, 2019, or 2035-2049.

In an embodiment, a binding protein capable of binding human sclerostin is provided and comprises:
  an Ig constant heavy region having an amino acid sequence of SEQ ID NO:3;
  an Ig constant light region having an amino acid sequence of SEQ ID NO:5;
  an Ig variable heavy region having an amino acid sequence of a VH in Table 18;
  an amino acid sequence of a VH of SEQ ID NO:3, 5, 7, 9, 11, 13, 1719-1866, 1998-2007, 2018, or 2020-2034; and
  an Ig variable light region having an amino acid sequence of a VL of SEQ ID NO:4, 6, 8, 10, 12, 14, 1867-1997, 2008-2017, 2019, or 2035-2049.

Another aspect provides a multivalent, multispecific DVD-binding protein comprising a polypeptide chain, wherein the polypeptide chain comprises VD1-(X1)n-VD2-C—(X2)n, wherein
  VD1 is a first heavy chain variable domain;
  VD2 is a second heavy chain variable domain;
  C is a heavy chain constant domain;
  X1 is a linker with the proviso that it is not CH1;
  X2 is an Fc region;
  (X1)n is (X1)0 or (X1)1; (X2)n is (X2)0 or (X2)1; and wherein
(a) VD1 or VD2 comprise three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, and the binding protein is capable of binding sclerostin and another target;
(b) VD1 and VD2 independently comprise three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, and the binding protein is capable of binding sclerostin and sclerostin;
(c) VD1 comprises three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, 1684, and VD2 comprises three CDRs from SEQ ID NO:22, 32, 42, 52, 62, 72, 82, 92, 102, 112, 122, 132, 142, 152, 162, 172, 182, 192, 202, 212, 222, 232, 242, 252, 262, 272, 282, 292, 302, 312, 322, 332, 342, 352, 362, 372, 382, 392, 402, 412, 422, 432, 442, 452, 462, 472, 482, 492, 502, 512, 522, 532, 542, 552, 562, 572, 582, 592, 602, 612, 622, 632, 642, 652, 662, 672, 682, 692, 702, 712, 722, 732, 742, 752, 762, 772, 782, 792, 802, 812, 822, 832, 842, 852, 862, 872, 882, 892, 902, 912, 922, 932, 942, 952, 962, 972, 982, 992, 1002, 1012, 1022, 1032, 1042, 1052, 1062, 1072, 1082, 1092, 1102, 1112, 1122, 1132, 1142, 1152, 1162, 1172, 1182, 1192, 1202, 1212, 1222, 1232, 1242, 1252, 1262, 1272, 1282, 1292, 1302, 1312, 1322, 1332, 1242, 1252, 1262, 1272, 1282, 1292, 1302, 1312, 1322, 1332, 1342, 1352, 1362, 1372, 1382, 1392, 1402, 1412, 1422, 1432, 1442, 1452, 1462, 1472, 1482, 1492, 1502, 1512, 1522, 1532, 1542, 1552, 1562, 1572, 1582, 1592, 1602, 1612, 1622, 1632, 1642, 1652, 1662, 1672, or 1682, and the binding protein is capable of binding sclerostin and TNF-α; or
(d) VD2 comprises three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, or 634, and VD1 comprises three CDRs from SEQ ID NO:22, 32, 42, 52, 62, 72, 82, 92, 102, 112, 122, 132, 142, 152, 162, 172, 182, 192, 202, 212, 222, 232, 242, 252, 262, 272, 282, 292, 302, 312, 322, 332, 342, 352, 362, 372, 382, 392, 402, 412, 422, 432, 442, 452, 462, 472, 482, 492, 502, 512, 522, 532, 542, 552, 562, 572, 582, 592, 602, 612, 622, 632, 642, 652, 662, 672, 682, 692, 702, 712, 722, 732, 742, 752, 762, 772, 782, 792, 802, 812, 822, 832, 842, 852, 862, 872, 882, 892, 902, 912, 922, 932, 942, 952, 962, 972, 982, 992, 1002, 1012, 1022, 1032, 1042, 1052, 1062, 1072, 1082, 1092, 1102, 1112, 1122, 1132, 1142, 1152, 1162, 1172, 1182, 1192, 1202, 1212, 1222, 1232, 1242, 1252, 1262, 1272, 1282, 1292, 1302, 1312, 1322, 1332, 1342, 1352, 1362, 1372, 1382, 1392, 1402, 1412, 1422, 1432, 1442, 1452, 1462, 1472, 1482, 1492, 1502, 1512, 1522, 1532, 1542, 1552, 1562, 1572, 1582, 1592, 1602, 1612, 1622, 1632, 1642, 1652, 1662, 1672, or 1682, and the binding protein is capable of binding TNF-α and sclerostin.

In an embodiment of the DVD-binding protein described above, VD1-(X1)n-VD2 comprises SEQ ID NO:21, 31, 41, 51, 61, 71, 81, 91, 101, 111, 121, 131, 141, 151, 161, 171, 181, 191, 201, 211, 221, 231, 241, 251, 261, 271, 281, 291, 301, 311, 321, 331, 341, 351, 361, 371, 381, 391, 401, 411, 421, 431, 441, 451, 461, 471, 481, 491, 501, 511, 521, 531, 541, 551, 561, 571, 581, 591, 601, 611, 621, 631, 641, 651, 661, 671, 681, 691, 701, 711, 721, 731, 741, 751, 761, 771, 781, 791, 801, 811, 821, 831, 841, 851, 861, 871, 881, 891, 901, 911, 921, 931, 941, 951, 961, 971, 981, 991, 1001, 1011, 1021, 1031, 1041, 1051, 1061, 1071, 1081, 1091, 1101, 1111, 1121, 1131, 1141, 1151, 1161, 1171, 1181, 1191, 1201, 1211, 1221, 1231, 1241, 1251, 1261, 1271, 1281, 1291, 1301, 1311, 1321, 1331, 1341, 1351, 1361, 1371, 1381, 1391, 1401, 1411, 1421, 1431, 1441, 1451, 1461, 1471, 1481, 1491, 1501, 1511, 1521, 1531, 1541, 1551, 1561, 1571, 1581, 1591, 1601, 1611, 1621, 1631, 1641, 1651, 1661, 1671, or 1681.

Another aspect provides a multivalent, multispecific DVD-binding protein comprising a polypeptide chain, wherein the polypeptide chain comprises VD1-(X1)n-VD2-C—(X2)n, wherein
VD1 is a first light chain variable domain;
VD2 is a second light chain variable domain;
C is a light chain constant domain;
X1 is a linker with the proviso that it is not CL;
X2 does not comprise an Fc region;
(X1)n is (X1)0 or (X1)1;
(X2)n is (X2)0 or (X2)1; and
wherein
(a) VD1 or VD2 comprise three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and the binding protein is capable of binding sclerostin and another target;

(b) VD1 and VD2 independently comprise three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and the binding protein is capable of binding sclerostin and sclerostin;

(c) VD1 comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and VD2 comprises three CDRs from SEQ ID NO:27, 37, 47, 57, 67, 77, 87, 97, 107, 117, 127, 137, 147, 157, 167, 177, 187, 197, 207, 217, 227, 237, 247, 257, 267, 277, 287, 297, 307, 317, 327, 337, 347, 357, 367, 377, 387, 397, 407, 417, 427, 437, 447, 457, 467, 477, 487, 497, 507, 517, 527, 537, 547, 557, 567, 577, 587, 597, 607, 617, 627, 637, 647, 657, 667, 677, 687, 697, 707, 717, 727, 737, 747, 757, 767, 777, 787, 797, 807, 817, 827, 837, 847, 857, 867, 877, 887, 897, 907, 917, 927, 937, 947, 957, 967, 977, 987, 997, 1007, 1017, 1027, 1037, 1047, 1057, 1067, 1077, 1087, 1097, 1107, 1117, 1127, 1137, 1147, 1157, 1167, 1177, 1187, 1197, 1207, 1217, 1227, 1237, 1247, 1257, 1267, 1277, 1287, 1297, 1307, 1317, 1327, 1337, 1347, 1357, 1367, 1377, 1387, 1397, 1407, 1417, 1427, 1437, 1447, 1457, 1467, 1477, 1487, 1497, 1507, 1517, 1527, 1537, 1547, 1557, 1567, 1577, 1587, 1597, 1607, 1617, 1627, 1637, 1647, 1657, 1667, 1677, or 1687, and the binding protein is capable of binding sclerostin and TNF-α; or (d) VD2 comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and VD1 comprises three CDRs from SEQ ID NO:27, 37, 47, 57, 67, 77, 87, 97, 107, 117, 127, 137, 147, 157, 167, 177, 187, 197, 207, 217, 227, 237, 247, 257, 267, 277, 287, 297, 307, 317, 327, 337, 347, 357, 367, 377, 387, 397, 407, 417, 427, 437, 447, 457, 467, 477, 487, 497, 507, 517, 527, 537, 547, 557, 567, 577, 587, 597, 607, 617, 627, 637, 647, 657, 667, 677, 687, 697, 707, 717, 727, 737, 747, 757, 767, 777, 787, 797, 807, 817, 827, 837, 847, 857, 867, 877, 887, 897, 907, 917, 927, 937, 947, 957, 967, 977, 987, 997, 1007, 1017, 1027, 1037, 1047, 1057, 1067, 1077, 1087, 1097, 1107, 1117, 1127, 1137, 1147, 1157, 1167, 1177, 1187, 1197, 1207, 1217, 1227, 1237, 1247, 1257, 1267, 1277, 1287, 1297, 1307, 1317, 1327, 1337, 1347, 1357, 1367, 1377, 1387, 1397, 1407, 1417, 1427, 1437, 1447, 1457, 1467, 1477, 1487, 1497, 1507, 1517, 1527, 1537, 1547, 1557, 1567, 1577, 1587, 1597, 1607, 1617, 1627, 1637, 1647, 1657, 1667, 1677, or 1687, and the binding protein is capable of binding TNF-α and sclerostin.

In an embodiment of the DVD-binding protein described above, VD1-(X1)n-VD2 comprises SEQ ID NO:26, 36, 46, 56, 66, 76, 86, 96, 106, 116, 126, 136, 146, 156, 166, 176, 186, 196, 206, 216, 226, 236, 246, 256, 266, 276, 286, 296, 306, 316, 326, 336, 346, 356, 366, 376, 386, 396, 406, 416, 426, 436, 446, 456, 466, 476, 486, 496, 506, 516, 526, 536, 546, 556, 566, 576, 586, 596, 606, 616, 626, 636, 646, 656, 666, 676, 686, 696, 706, 716, 726, 736, 746, 756, 766, 776, 786, 796, 806, 816, 826, 836, 846, 856, 866, 876, 886, 896, 906, 916, 926, 936, 946, 956, 966, 976, 986, 996, 1006, 1116, 1126, 1136, 1146, 1156, 1166, 1176, 1186, 1196, 1206, 1216, 1226, 1236, 1246, 1256, 1266, 1276, 1286, 1296, 1306, 1316, 1326, 1336, 1346, 1356, 1366, 1376, 1386, 1396, 1406, 1416, 1426, 1436, 1446, 1456, 1466, 1476, 1486, 1496, 1506, 1516, 1526, 1536, 1546, 1556, 1566, 1576, 1586, 1596, 1606, 1616, 1626, 1636, 1646, 1656, 1666, 1676, or 1686.

Another embodiment provides a multivalent, multispecific DVD-A binding protein comprising first and second polypeptide chains, wherein the first polypeptide chain comprises a first VD1-(X1)n-VD2-C—(X2)n, wherein VD1 is a first heavy chain variable domain;
VD2 is a second heavy chain variable domain;
C is a heavy chain constant domain;
X1 is a first linker;
X2 is an Fc region;
(X1)n is (X1)0 or (X1)1;
(X2)n is (X2)0 or (X2)1; and wherein the second polypeptide chain comprises a second VD1-(X1)n-VD2-C—(X2)n, wherein
VD1 is a first light chain variable domain;
VD2 is a second light chain variable domain;
C is a light chain constant domain;
X1 is a second linker;
X2 does not comprise an Fc region; (X1)n is (X1)0 or (X1)1;
(X2)n is (X2)0 or (X2)1; and
wherein the first and second X1 linker are the same or different;
wherein the first X1 linker is not CH1 and/or the second X1 linker is not CL and
wherein (a) the VD1 or VD2 heavy chain variable domain comprise three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, the VD1 or VD2 light chain variable domain comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and the binding protein is capable of binding sclerostin and another target;

(b) the VD1 and VD2 heavy chain variable domains independently comprise three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, the VD1 or VD2 light chain variable domain comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479.1489, 1499, 1509, 1519, 1529, 1539, 1549, 1559, 1569, 1579, 1589, 1599, 1609, 1619, 1629, 1639, 1649, 1659, 1669, 1679, or 1689, and the binding protein is capable of binding sclerostin and sclerostin;

(c) the VD1 heavy chain variable domain comprises three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, and the VD2 heavy chain variable domain comprises three CDRs from SEQ ID NO:22, 32, 42, 52, 62, 72, 82, 92, 102, 112, 122, 132, 142, 152, 162, 172, 182, 192, 202, 212, 222, 232, 242, 252, 262, 272, 282, 292, 302, 312, 322, 332, 342, 352, 362, 372, 382, 392, 402, 412, 422, 432, 442, 452, 462, 472, 482, 492, 502, 512, 522, 532, 542, 552, 562, 572, 582, 592, 602, 612, 622, 632, 642, 652, 662, 672, 682, 692, 702, 712, 722, 732, 742, 752, 762, 772, 782, 792, 802, 812, 822, 832, 842, 852, 862, 872, 882, 892, 902, 912, 922, 932, 942, 952, 962, 972, 982, 992, 1002, 1012, 1022, 1032, 1042, 1052, 1062, 1072, 1082, 1092, 1102, 1112, 1122, 1132, 1142, 1152, 1162, 1172, 1182, 1192, 1202, 1212, 1222, 1232, 1242, 1252, 1262, 1272, 1282, 1292, 1302, 1312, 1322, 1332, 1242, 1252, 1262, 1272, 1282, 1292, 1302, 1312, 1322, 1332, 1342, 1352, 1362, 1372, 1382, 1392, 1402, 1412, 1422, 1432, 1442, 1452, 1462, 1472, 1482, 1492, 1502, 1512, 1522, 1532, 1542, 1552, 1562, 1572, 1582, 1592, 1602, 1612, 1622, 1632, 1642, 1652, 1662, 1672, or 1682; the VD1 light chain variable domain comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and the VD2 light chain variable domain comprises three CDRs from SEQ ID NO:27, 37, 47, 57, 67, 77, 87, 97, 107, 117, 127, 137, 147, 157, 167, 177, 187, 197, 207, 217, 227, 237, 247, 257, 267, 277, 287, 297, 307, 317, 327, 337, 347, 357, 367, 377, 387, 397, 407, 417, 427, 437, 447, 457, 467, 477, 487, 497, 507, 517, 527, 537, 547, 557, 567, 577, 587, 597, 607, 617, 627, 637, 647, 657, 667, 677, 687, 697, 707, 717, 727, 737, 747, 757, 767, 777, 787, 797, 807, 817, 827, 837, 847, 857, 867, 877, 887, 897, 907, 917, 927, 937, 947, 957, 967, 977, 987, 997, 1007, 1017, 1027, 1037, 1047, 1057, 1067, 1077, 1087, 1097, 1107, 1117, 1127, 1137, 1147, 1157, 1167, 1177, 1187, 1197, 1207, 1217, 1227, 1237, 1247, 1257, 1267, 1277, 1287, 1297, 1307, 1317, 1327, 1337, 1347, 1357, 1367, 1377, 1387, 1397, 1407, 1417, 1427, 1437, 1447, 1457, 1467, 1477, 1487, 1497, 1507, 1517, 1527, 1537, 1547, 1557, 1567, 1577, 1587, 1597, 1607, 1617, 1627, 1637, 1647, 1657, 1667, 1677, or 1687, and the binding protein is capable of binding sclerostin and TNF-α; or (d) the VD2 heavy chain variable domain comprises three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, and the VD1 heavy chain variable domain comprises three CDRs from SEQ ID NO:22, 32, 42, 52, 62, 72, 82, 92, 102, 112, 122, 132, 142, 152, 162, 172, 182, 192, 202, 212, 222, 232, 242, 252, 262, 272, 282, 292, 302, 312, 322, 332, 342, 352, 362, 372, 382, 392, 402, 412, 422, 432, 442, 452, 462, 472, 482, 492, 502, 512, 522, 532, 542, 552, 562, 572, 582, 592, 602, 612, 622, 632, 642, 652, 662, 672, 682, 692, 702, 712, 722, 732, 742, 752, 762, 772, 782, 792, 802, 812, 822, 832, 842, 852, 862, 872, 882, 892, 902, 912, 922, 932, 942, 952, 962, 972, 982, 992, 1002, 1012, 1022, 1032, 1042, 1052, 1062, 1072, 1082, 1092, 1102, 1112, 1122, 1132, 1142, 1152, 1162, 1172, 1182, 1192, 1202, 1212, 1222, 1232, 1242, 1252, 1262, 1272, 1282, 1292, 1302, 1312, 1322, 1332, 1342, 1352, 1362, 1372, 1382, 1392, 1402, 1412, 1422, 1432, 1442, 1452, 1462, 1472, 1482, 1492, 1502, 1512, 1522, 1532, 1542, 1552, 1562, 1572, 1582, 1592, 1602, 1612, 1622, 1632, 1642, 1652, 1662, 1672, or 1682; the VD2 light chain variable domain comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and the VD1 light chain variable domain comprises three CDRs from SEQ ID NO:27, 37, 47, 57, 67, 77, 87, 97, 107, 117, 127, 137, 147, 157, 167, 177, 187, 197, 207, 217, 227, 237, 247, 257, 267, 277, 287, 297, 307, 317, 327, 337, 347, 357, 367, 377, 387, 397, 407, 417, 427, 437, 447, 457, 467, 477, 487, 497, 507, 517, 527, 537, 547, 557, 567, 577, 587, 597, 607, 617, 627, 637, 647, 657, 667, 677, 687, 697, 707, 717, 727, 737, 747, 757, 767, 777, 787, 797, 807, 817, 827, 837, 847, 857, 867, 877, 887, 897, 907, 917, 927, 937, 947, 957, 967, 977, 987, 997, 1007, 1017, 1027, 1037, 1047, 1057, 1067, 1077, 1087, 1097, 1107, 1117, 1127, 1137, 1147, 1157, 1167, 1177, 1187, 1197, 1207, 1217, 1227, 1237, 1247, 1257, 1267, 1277, 1287, 1297, 1307, 1317, 1327, 1337, 1347, 1357, 1367, 1377, 1387, 1397, 1407, 1417, 1427, 1437, 1447, 1457, 1467, 1477, 1487, 1497, 1507, 1517, 1527, 1537, 1547, 1557, 1567, 1577, 1587, 1597, 1607, 1617, 1627, 1637, 1647, 1657, 1667, 1677, or 1687, and the binding protein is capable of binding TNF-α and sclerostin.

In an embodiment of the DVD-binding protein described above, wherein X1 or X2 is SEQ ID NO:1695, 1696, 1697, 1698, 1699, 1700, 1701, 1702, 1703, 1704, 1705, 1706, 1707, 1708, 1709, 1710, 1711, 1712, 1713, 1714, 1715, 1716, 2050, 2051, 2052, 2053, 2054, 2055, 2056, 2057, 2058, and 2059.

Another embodiment provides a multivalent, multispecific DVD-A binding protein capable of binding two antigens comprising four polypeptide chains, wherein two polypeptide chains comprise VD1-(X1)n-VD2-C—(X2)n, wherein
VD1 is a first heavy chain variable domain;
VD2 is a second heavy chain variable domain;
C is a heavy chain constant domain;
X1 is a first linker;
X2 is an Fc region;
(X1)n is (X1)0 or (X1)1;
(X2)n is (X2)0 or (X2)1; and
wherein two polypeptide chains comprise VD1-(X1)n-VD2-C—(X2)n, wherein
VD1 is a first light chain variable domain;
VD2 is a second light chain variable domain;
C is a light chain constant domain;
X1 is a second linker;
X2 does not comprise an Fc region;
(X1)n is (X1)0 or (X1)1;
(X2)n is (X2)0 or (X2)1; and
wherein the first and second X1 linker are the same or different;

wherein the first X1 linker is not CH1 and/or the second X1 linker is not CL and wherein (a) the VD1 or VD2 heavy chain variable domain comprise three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, the VD1 or VD2 light chain variable domain comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and the binding protein is capable of binding sclerostin and another target;

(b) the VD1 and VD2 heavy chain variable domains independently comprise three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, the VD1 or VD2 light chain variable domain comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479.1489, 1499, 1509, 1519, 1529, 1539, 1549, 1559, 1569, 1579, 1589, 1599, 1609, 1619, 1629, 1639, 1649, 1659, 1669, 1679, or 1689, and the binding protein is capable of binding sclerostin and sclerostin;

(c) the VD1 heavy chain variable domain comprises three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, and the VD2 heavy chain variable domain comprises three CDRs from SEQ ID NO:22, 32, 42, 52, 62, 72, 82, 92, 102, 112, 122, 132, 142, 152, 162, 172, 182, 192, 202, 212, 222, 232, 242, 252, 262, 272, 282, 292, 302, 312, 322, 332, 342, 352, 362, 372, 382, 392, 402, 412, 422, 432, 442, 452, 462, 472, 482, 492, 502, 512, 522, 532, 542, 552, 562, 572, 582, 592, 602, 612, 622, 632, 642, 652, 662, 672, 682, 692, 702, 712, 722, 732, 742, 752, 762, 772, 782, 792, 802, 812, 822, 832, 842, 852, 862, 872, 882, 892, 902, 912, 922, 932, 942, 952, 962, 972, 982, 992, 1002, 1012, 1022, 1032, 1042, 1052, 1062, 1072, 1082, 1092, 1102, 1112, 1122, 1132, 1142, 1152, 1162, 1172, 1182, 1192, 1202, 1212, 1222, 1232, 1242, 1252, 1262, 1272, 1282, 1292, 1302, 1312, 1322, 1332, 1242, 1252, 1262, 1272, 1282, 1292, 1302, 1312, 1322, 1332, 1342, 1352, 1362, 1372, 1382, 1392, 1402, 1412, 1422, 1432, 1442, 1452, 1462, 1472, 1482, 1492, 1502, 1512, 1522, 1532, 1542, 1552, 1562, 1572, 1582, 1592, 1602, 1612, 1622, 1632, 1642, 1652, 1662, 1672, or 1682; the VD1 light chain variable domain comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and the VD2 light chain variable domain comprises three CDRs from SEQ ID NO:27, 37, 47, 57, 67, 77, 87, 97, 107, 117, 127, 137, 147, 157, 167, 177, 187, 197, 207, 217, 227, 237, 247, 257, 267, 277, 287, 297, 307, 317, 327, 337, 347, 357, 367, 377, 387, 397, 407, 417, 427, 437, 447, 457, 467, 477, 487, 497, 507, 517, 527, 537, 547, 557, 567, 577, 587, 597, 607, 617, 627, 637, 647, 657, 667, 677, 687, 697, 707, 717, 727, 737, 747, 757, 767, 777, 787, 797, 807, 817, 827, 837, 847, 857, 867, 877, 887, 897, 907, 917, 927, 937, 947, 957, 967, 977, 987, 997, 1007, 1017, 1027, 1037, 1047, 1057, 1067, 1077, 1087, 1097, 1107, 1117, 1127, 1137, 1147, 1157, 1167, 1177, 1187, 1197, 1207, 1217, 1227, 1237, 1247, 1257, 1267, 1277, 1287, 1297, 1307, 1317, 1327, 1337, 1347, 1357, 1367, 1377, 1387, 1397, 1407, 1417, 1427, 1437, 1447, 1457, 1467, 1477, 1487, 1497, 1507, 1517, 1527, 1537, 1547, 1557, 1567, 1577, 1587, 1597, 1607, 1617, 1627, 1637, 1647, 1657, 1667, 1677, or 1687, and the binding protein is capable of binding sclerostin and TNF-α; or (d) the VD2 heavy chain variable domain comprises three CDRs from SEQ ID NO:24, 34, 44, 54, 64, 74, 84, 94, 104, 114, 124, 134, 144, 154, 164, 174, 184, 194, 204, 214, 224, 234, 244, 254, 264, 274, 284, 294, 304, 314, 324, 334, 344, 354, 364, 374, 384, 394, 404, 414, 424, 434, 444, 454, 464, 474, 484, 494, 504, 514, 524, 534, 544, 554, 564, 574, 584, 594, 604, 614, 624, 634, 644, 654, 664, 674, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, or 1684, and the VD1 heavy chain variable domain comprises three CDRs from SEQ ID NO:22, 32, 42, 52, 62, 72, 82, 92, 102, 112, 122, 132, 142, 152, 162, 172, 182, 192, 202, 212, 222, 232, 242, 252, 262, 272, 282, 292, 302, 312, 322, 332, 342, 352, 362, 372, 382, 392, 402, 412, 422, 432, 442, 452, 462, 472, 482, 492, 502, 512, 522, 532, 542, 552, 562, 572, 582, 592, 602, 612, 622, 632, 642, 652, 662, 672, 682, 692, 702, 712, 722, 732, 742, 752, 762, 772, 782, 792, 802, 812, 822, 832, 842, 852, 862, 872, 882, 892, 902, 912, 922, 932, 942, 952, 962, 972, 982, 992, 1002, 1012, 1022, 1032, 1042, 1052, 1062, 1072, 1082, 1092, 1102, 1112, 1122, 1132, 1142, 1152, 1162, 1172, 1182, 1192, 1202, 1212, 1222, 1232, 1242, 1252, 1262, 1272, 1282, 1292, 1302, 1312, 1322, 1332, 1242, 1252, 1262, 1272, 1282, 1292, 1302, 1312, 1322, 1332, 1342, 1352, 1362, 1372, 1382, 1392, 1402, 1412, 1422, 1432, 1442, 1452, 1462, 1472, 1482, 1492, 1502, 1512, 1522, 1532, 1542, 1552, 1562, 1572, 1582, 1592, 1602, 1612, 1622, 1632, 1642, 1652, 1662, 1672, or 1682; the VD2 light chain variable domain comprises three CDRs from SEQ ID NO:29, 39, 49, 59, 69, 79, 89, 99, 109, 119, 129, 139, 149, 159, 169, 179, 189, 199, 209, 219, 229, 239, 249, 259, 269, 279, 289, 299, 309, 319, 329, 339, 349, 359, 369, 379, 389, 399, 409, 419, 429, 439, 449, 459, 469, 479, 489, 499, 509, 519, 529, 539, 549, 559, 569, 579, 589, 599, 609, 619, 629, 639, 649, 659, 669, 679, 689, 699, 709, 719, 729, 739, 749, 759, 769, 779, 789, 799, 809, 819, 829, 839, 849, 859, 869, 879, 889, 899, 909, 919, 929, 939, 949, 959, 969, 979, 989, 999, 1009, 1019, 1029, 1039, 1049, 1059, 1069, 1079, 1089, 1099, 1109, 1119, 1129, 1139, 1149, 1159, 1169, 1179, 1189, 1199, 1209, 1219, 1229, 1239, 1249, 1259, 1269, 1279, 1289, 1299, 1309, 1319, 1329, 1339, 1349, 1359, 1369, 1379, 1389, 1399, 1409, 1419, 1429, 1439, 1449, 1459, 1469, 1479. 1489, 1499, 1509, 1519, 1529, 1539, 1549, 1559, 1569, 1579, 1589, 1599, 1609, 1619, 1629, 1639, 1649, 1659, 1669, 1679, or 1689, and the VD1 light chain variable domain comprises three CDRs from SEQ ID NO: 27, 37, 47, 57, 67, 77, 87, 97, 107, 117, 127, 137, 147, 157, 167, 177, 187, 197, 207, 217, 227, 237, 247, 257, 267, 277, 287, 297, 307, 317, 327, 337, 347, 357, 367, 377, 387, 397, 407, 417, 427, 437, 447, 457, 467, 477, 487, 497, 507, 517, 527, 537, 547, 557, 567, 577, 587, 597, 607, 617, 627, 637, 647, 657, 667, 677, 687, 697, 707, 717, 727, 737, 747, 757, 767, 777, 787, 797, 807, 817, 827, 837, 847, 857, 867, 877, 887, 897, 907, 917, 927, 937, 947, 957, 967, 977, 987, 997, 1007, 1017, 1027, 1037, 1047, 1057, 1067, 1077, 1087, 1097, 1107, 1117, 1127, 1137, 1147, 1157, 1167, 1177, 1187, 1197, 1207, 1217, 1227, 1237, 1247, 1257, 1267, 1277, 1287, 1297, 1307, 1317, 1327, 1337, 1347, 1357, 1367, 1377, 1387, 1397, 1407, 1417, 1427, 1437, 1447, 1457, 1467, 1477, 1487, 1497, 1507, 1517, 1527, 1537, 1547, 1557, 1567, 1577, 1587, 1597, 1607, 1617, 1627, 1637, 1647, 1657, 1667, 1677, or 1687, and the binding protein is capable of binding TNF-α and sclerostin.

In an embodiment of a multivalent, multispecific DVD-binding protein described herein, n is 0.

An embodiment of a multivalent, multispecific DVD-binding protein is provided, wherein X1 or X2 is SEQ ID NO: 1695, 1696, 1697, 1698, 1699, 1700, 1701, 1702, 1703, 1704, 1705, 1706, 1707, 1708, 1709, 1710, 1711, 1712, 1713, 1714, 1715, 1716, 2050, 2051, 2052, 2053, 2054, 2055, 2056, 2057, 2058, and 2059.

In another embodiment, a multivalent, multispecific DVD-binding protein described herein comprises two first polypeptide chains and two second polypeptide chains.

In an embodiment of a multivalent, multispecific DVD-binding protein described herein, the Fc region is a native sequence Fc region or a variant sequence Fc region.

In an embodiment, the Fc region is an Fc region from an IgG1, IgG2, IgG3, IgG4, IgA, IgM, IgE, or IgD.

In another embodiment of a multivalent, multispecif DVD-binding protein described herein comprising a first and second polypeptide chains, VD1 of the first polypeptide chain and said VD1 of the second polypeptide chain are obtained from the same first and second parent antibody, respectively, or antigen binding portion thereof.

In an embodiment of a TNF-α and sclerostin DVD-binding protein described herein, a parental anti-TNF-α antibody binds TNF-α with a potency different from the potency with which a parental anti-sclerostin antibody binds human sclerostin.

In another embodiment of a TNF-α and SOST DVD-binding protein described herein, a parental anti-TNF-α antibody binds TNF-α with an affinity different from the affinity with which said anti-sclerostin antibody binds human sclerostin.

In another embodiment of a TNF-α and SOST DVD-binding protein described herein, an anti-TNF-α antibody and said anti-sclerostin antibody are a human antibody, a CDR grafted antibody, or a humanized antibody.

In another embodiment, a TNF-α and SOST DVD-binding protein described herein possesses at least one desired property exhibited by said anti-TNF-α antibody or said anti-sclerostin antibody. In an embodiment, the desired property is one or more antibody parameters. In an embodiment, the antibody parameters are antigen specificity, affinity to antigen, potency, biological function, epitope recognition, stability, solubility, production efficiency, immunogenicity, pharmacokinetics, bioavailability, tissue cross reactivity, or orthologous antigen binding.

Another embodiment provides a method of producing a multivalent, multispecific DVD-binding protein described herein, comprising culturing a host cell carrying a vector comprising a nucleic acid described herein in culture medium under conditions sufficient to produce the binding protein. In an embodiment, 50%-75% of the binding protein produced according the method is a dual specific tetravalent DVD-binding protein described herein. In an embodiment, 75%-90% of the binding protein produced according to this method is a dual specific tetravalent binding protein. In an embodiment, 90%-95% of the binding protein produced is a dual specific tetravalent binding protein.

Another embodiment provides a protein produced according to the described method.

In another embodiment, a pharmaceutical composition comprising a multivalent, multispecific DVD-binding protein described herein and a pharmaceutically acceptable carrier is provided.

In another embodiment, a pharmaceutical composition comprising a multivalent, multispecific DVD-binding protein further comprises at least one additional agent. In an embodiment, the additional agent is a therapeutic agent; an imaging agent; a cytotoxic agent; an angiogenesis inhibitor; a kinase inhibitor; a co-stimulation molecule blocker; an adhesion molecule blocker; an anti-cytokine antibody or functional fragment thereof; methotrexate; cyclosporin; rapamycin; FK506; a detectable label or reporter; a TNF antagonist; an antirheumatic; a muscle relaxant, a narcotic, a non-steroid anti-inflammatory drug (NSAID); an analgesic; an anesthetic; a sedative; a local anesthetic; a neuromuscular blocker; an antimicrobial; an antipsoriatic; a corticosteroid; an anabolic steroid; an erythropoietin; an immunization; an immunoglobulin; an immunosuppressive; a growth hormone; a hormone replacement drug; a radiopharmaceutical; an antidepressant; an antipsychotic; a stimulant; an asthma medication; a beta agonist; an inhaled steroid; an epinephrine or analog; a cytokine; or a cytokine antagonist.

Another embodiment provides a method for treating a subject for a disease or a disorder by administering to the subject a multivalent, multispecific DVD-binding protein described herein that binds TNF-α and sclerostin such that treatment is achieved.

A method for generating a multivalent, multispecific DVD-binding protein described herein is provided, comprising the steps of:
a) obtaining a first parent antibody or antigen binding portion thereof
b) obtaining a second parent antibody or antigen binding portion thereof;
c) constructing polypeptide chains described herein;
e) expressing said polypeptide chains;
such that a DVD-binding protein is generated.

In another embodiment of the method described above, said first parent antibody or antigen binding portion thereof, and said second parent antibody or antigen binding portion thereof, are a human antibody, a CDR grafted antibody, or a humanized antibody.

In another embodiment of the method described above, said first parent antibody or antigen binding portion thereof, and said second parent antibody or antigen binding portion thereof, are an Fab fragment, an F(ab')$_2$ fragment, a bivalent fragment comprising two Fab fragments linked by a disulfide bridge at the hinge region; an Fd fragment consisting of the VH and CH1 domains; an Fv fragment consisting of the VL and VH domains of a single arm of an antibody, a dAb fragment, an isolated complementarity determining region (CDR), a single chain antibody, or diabodies.

In another embodiment of the method, the first parent antibody or antigen binding portion thereof possesses at least one desired property exhibited by the DVD-binding protein.

In another embodiment of the method described above the second parent antibody or antigen binding portion thereof possesses at least one desired property exhibited by the DVD-binding protein.

In an embodiment, in the method described above, the Fc region is a native sequence Fc region or a variant sequence Fc region. In an embodiment, the Fc region is an Fc region from an IgG1, IgG2, IgG3, IgG4, IgA, IgM, IgE, or IgD.

In another embodiment, in a method described above, a desired property is one or more antibody parameters of the first parent antibody or antigen binding portion thereof.

In another embodiment, in a method described above, a desired property is one or more antibody parameters of the second parent antibody.

In an embodiment, said antibody parameters are antigen specificity, affinity to antigen, potency, biological function, epitope recognition, stability, solubility, production efficiency, immunogenicity, pharmacokinetics, bioavailability, tissue cross reactivity, or orthologous antigen binding.

In another embodiment of the method described above, the first parent antibody or antigen binding portion thereof, binds said first antigen with a different affinity than the affinity with which said second parent antibody or antigen binding portion thereof, binds said second antigen.

In another embodiment, the first parent antibody or antigen binding portion thereof, binds said first antigen with a different potency than the potency with which said second parent antibody or antigen binding portion thereof, binds said second antigen.

In another embodiment, an sclerostin binding protein described herein binds human sclerostin and is capable of modulating a biological function of SOST.

A neutralizing binding protein is provided, wherein the neutralizing binding protein comprises aSclerostin binding protein as described above, and wherein said neutralizing binding protein is capable of neutralizing sclerostin.

In another embodiment, a neutralizing sclerostin binding protein that binds pro-human sclerostin, mature-human sclerostin, or truncated-human sclerostin is provided.

In an embodiment, a neutralizing sclerostin binding protein described herein diminishes the ability of sclerostin to bind to its receptor. In an embodiment, a neutralizing sclerostin binding protein diminishes the ability of pro-human sclerostin, mature human sclerostin, or a truncated human sclerostin to bind to the sclerostinreceptor.

In another embodiment, a neutralizing sclerostin binding protein described herein is capable of reducing one or more of sclerostin biological activities, including: including inhibition of osteoblast differentiation, and osteoblast function leading to inhibition of bone formation.

In an embodiment, an sclerostin binding protein having an on rate constant ($K_{on}$) to said target of: at least about $10^2$ $M^{-1}s^{-1}$; at least about $10^3 M^{-1}s^{-1}$; at least about $10^4 M^{-1}s^{-1}$; at least about $10^5 M^{-1}s^{-1}$; or at least about $10^6 M^{-1}s^{-1}$; as measured by surface plasmon resonance, is provided.

In another embodiment, an sclerostin binding protein having an off rate constant ($K_{off}$) to said target of: at most about $10^{-3} s^{-1}$; at most about $10^{-4} s^{-1}$; at most about $10^{-5} s^{-1}$; or at most about $10^{-6} s^{-1}$, as measured by surface plasmon resonance, is provided.

In another embodiment, an sclerostinbinding protein having a dissociation constant ($K_D$) to said target of: at most about $10^{-7}$ M; at most about $10^{-8}$ M; at most about $10^{-9}$ M; at most about $10^{-10}$ M; at most about $10^{-11}$ M; at most about $10^{-12}$ M; or at most $10^{-13}$ M, is provided.

Another aspect provides an sclerostinbinding protein construct that comprises an sclerostin binding protein described herein and further comprises a linker polypeptide or an immunoglobulin constant domain. In an embodiment, the sclerostin binding protein construct is provided, wherein said construct comprises an sclerostin binding protein of an immunoglobulin molecule, a disulfide linked Fv, a monoclonal antibody, an scFv, a chimeric antibody, a single domain antibody, a CDR-grafted antibody, a diabody, a humanized antibody, a multispecific antibody, an Fab, a dual specific antibody, an Fab', a bispecific antibody, an F(ab')2, an Fv, or a DVD-binding protein.

In an embodiment, an sclerostin binding protein construct is provided, wherein said construct comprises a heavy chain immunoglobulin constant domain of a human IgM constant domain, a human IgG4 constant domain, a human IgG1 constant domain, a human IgE constant domain, a human IgG2 constant domain, a human IgG3 constant domain, or a human IgA constant domain.

In yet another embodiment, asclerostin binding protein construct comprises an immunoglobulin constant domain having an amino acid sequence SEQ ID NO: 2060; SEQ ID NO: 2061; SEQ ID NO:2062; SEQ ID NO:2063; SEQ ID NO:2064; and SEQ ID NO:2065.

In another embodiment, a sclerostin binding protein construct described herein has a greater half life in vivo than the soluble counterpart of said sclerostin binding protein construct.

Another aspect provides asclerostin binding protein conjugate comprising asclerostin binding protein construct, wherein the sclerostin binding protein conjugate further comprises an immunoadhesion molecule, an imaging agent, a therapeutic agent, or a cytotoxic agent.

Exemplary imaging agents useful in making sclerostin binding protein are provided and include, but are not limited to, a radiolabel, an enzyme, a fluorescent label, a luminescent label, a bioluminescent label, a magnetic label, and biotin.

Exemplary radiolabels are provided and include, but are not limited, to $^3$H, $^{14}$C, $^{35}$S, $^{90}$Y, $^{99}$TC, $^{111}$In, $^{125}$I, $^{131}$I, $^{177}$Lu, $^{166}$Ho, or $^{153}$Sm.

In another embodiment, asclerostin binding protein conjugate comprising a therapeutic or cytotoxic agent are provided, said agent further comprising an anti-metabolite, an alkylating agent, an antibiotic, a growth factor, a cytokine, an anti-angiogenic agent, an anti-mitotic agent, an anthracycline, toxin, or an apoptotic agent.

In another embodiment, binding proteins described herein possesses a human glycosylation pattern.

In another embodiment, asclerostin binding protein described herein, including sclerostin binding protein constructs and sclerostin binding protein conjugates, may be in the form of a crystallized binding protein. Exemplary crystalline forms retain at least some of the biologically activity of the uncrystallized form of asclerostin binding protein described herein. Such crystalline forms may also be used as a carrier-free pharmaceutical controlled release crystallized sclerostin binding proteins.

Another embodiment provides isolated nucleic acids encoding sclerostin binding proteins, including binding protein constructs, described herein. Such nucleic acids may be inserted into a vector for carrying out various genetic analyses and recombinant techniques for expressing, characterizing, or improving one or more properties of asclerostin binding protein described herein. Exemplary vectors for cloning nucleic acids encoding binding proteins described herein include, but are not limited, pcDNA, pTT, pTT3, pEFBOS, pBV, pJV, and pBJ.

A host cell comprising a vector comprising a nucleic acid encoding a binding protein are provided and described herein. Host cells are provided and may be prokaryotic or eukaryotic. An exemplary prokaryotic host cell is *Escherichia coli*. Eukaryotic cells useful as host cells are provided and include protist cell, animal cell, plant cell, and fungal cell.

An exemplary fungal cell is a yeast cell, including *Saccharomyces cerevisiae*. An exemplary animal cell useful as a host cell is provided and includes, but is not limited to, a mammalian cell, an avian cell, and an insect cell. Exemplary mammalian cells include CHO and COS cells. An insect cell useful as a host cell is provided and is an insect Sf9 cell.

A vector may comprise a nucleic acid encoding a sclerostin binding protein described herein in which the nucleic acid is operably linked to appropriate transcriptional and/or translational sequences that permit expression of the binding protein in a particular host cell carrying the vector.

Another aspect provides a method of producing asclerostin binding protein comprising culturing a host cell comprising a vector encoding the sclerostin binding protein in culture medium under conditions sufficient to produce the binding protein capable of binding sclerostin. The protein so produced can be isolated and used in various compositions and methods described herein.

Compositions are provided and include a composition for the release of a binding protein, wherein said composition comprises: (a) a formulation, wherein said formulation comprises a crystallized binding protein, described herein, and an ingredient; and (b) at least one polymeric carrier.

Exemplary polymeric carriers useful in compositions are provided and include, without limitation, one or more of the group consisting of: poly (acrylic acid), poly (cyanoacrylates), poly (amino acids), poly (anhydrides), poly (depsipeptide), poly (esters), poly (lactic acid), poly (lactic-co-glycolic acid) or PLGA, poly (b-hydroxybutryate), poly (caprolactone), poly (dioxanone); poly (ethylene glycol), poly ((hydroxypropyl) methacrylamide, poly [(organo) phosphazene], poly (ortho esters), poly (vinyl alcohol), poly (vinylpyrrolidone), maleic anhydride-alkyl vinyl ether copolymers, pluronic polyols, albumin, alginate, cellulose and cellulose derivatives, collagen, fibrin, gelatin, hyaluronic acid, oligosaccharides, glycaminoglycans, sulfated polysaccharides, blends and copolymers thereof.

In another aspect, an ingredient of a composition is provided, wherein the ingredient is albumin, sucrose, trehalose, lactitol, gelatin, hydroxypropyl-β-cyclodextrin, methoxypolyethylene glycol or polyethylene glycol.

Another embodiment provides a method for treating a mammal comprising the step of administering to the mammal an effective amount of a composition described herein.

Pharmaceutical compositions comprising a sclerostin binding protein described herein and a pharmaceutically acceptable carrier are provided. A pharmaceutically acceptable carrier may also serve as an adjuvant to increase the absorption or dispersion of the sclerostin binding protein in a composition. An exemplary adjuvant is hyaluronidase.

In another embodiment, a pharmaceutical composition further comprises at least one additional therapeutic agent for treating a disorder in which SOST activity is detrimental.

Another embodiment provides a method for reducing human SOST activity comprising contacting human SOST with a sclerostin binding protein herein such that human SOST activity is reduced.

In another embodiment, a pharmaceutical composition comprising a sclerostin binding protein described herein comprises at least one additional agent. In an embodiment, the additional agent is a therapeutic agent; an imaging agent; a cytotoxic agent; an angiogenesis inhibitors; a kinase inhibitors; a co-stimulation molecule blockers; an adhesion molecule blockers; a anti-cytokine antibody or functional fragment thereof; methotrexate; cyclosporin; rapamycin; FK506; a detectable label or reporter; a TNF antagonist; an antirheumatic; a muscle relaxant; a narcotic; a non-steroid anti-inflammatory drug (NSAID); an analgesic; an anesthetic; a sedative; a local anesthetic; a neuromuscular blocker; an antimicrobial; an antipsoriatic; a corticosteroid; an anabolic steroid; an erythropoietin; an immunization; an immunoglobulin; an immunosuppressive; a growth hormone; a hormone replacement drug; a radiopharmaceutical; an antidepressant; an antipsychotic; a stimulant; an asthma medication; a beta agonist; an inhaled steroid; an epinephrine or analog; a cytokine; or a cytokine antagonist. Another embodiment provides a method for treating a subject for a disease or a disorder by administering to the subject a multivalent, multispecific DVD-binding protein described herein that binds TNF-α and sclerostin such that treatment is achieved.

In another embodiment, a disorder that may treated by a method of administering to a subject a sclerostin binding protein described herein is provided, wherein the disorder is rheumatoid arthritis, osteoarthritis, juvenile chronic arthritis, septic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acquired immunodeficiency syndrome, acute transverse myelitis, Huntington's chorea, Parkinson's disease, Alzheimer's disease, stroke, primary biliary cirrhosis, hemolytic anemia, malignancies, heart failure, myocardial infarction, Addison's disease, sporadic, polyglandular deficiency type I and polyglandular deficiency type II, Schmidt's syndrome, adult (acute) respiratory distress syndrome, alopecia, alopecia greata, seronegative arthropathy, arthropathy, Reiter's disease, psoriatic arthropathy, ulcerative colitic arthropathy, enteropathic synovitis, chlamydia, yersinia and salmonella associated arthropathy, spondyloarthropathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cryptogenic autoimmune hepatitis, Acquired Immunodeficiency Disease Syndrome, Acquired Immunodeficiency Related Diseases, Hepatitis B, Hepatitis C, common varied immunodeficiency (common variable hypogammaglobulinaemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjögren's disease associated lung disease, ankylosing spondylitis associated lung disease, vasculitic diffuse lung disease, haemosiderosis associated lung disease, drug-induced interstitial lung disease, fibrosis, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycaemia, type B insulin resistance with acanthosis nigricans, hypoparathyroidism, acute immune disease associated with organ transplantation, chronic immune disease associated with organ transplantation, osteoarthrosis, primary sclerosing cholangitis, psoriasis type 1, psoriasis type 2, idiopathic leucopaenia, autoimmune neutropaenia, renal disease NOS, glomerulonephritides, microscopic vasculitis of the kidneys, Lyme disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis, Still's disease, systemic sclerosis, Sjörgren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoedema, phacogenic uveitis, primary vasculitis, vitiligo acute liver disease, chronic liver diseases, alcoholic cirrhosis, alcohol-induced liver injury, choleosatatis, idiosyncratic liver disease, Drug-Induced hepatitis, Non-alcoholic Steatohepatitis, allergy and asthma, group B streptococci (GBS) infection, mental disorders (e.g., depression and schizophrenia), Th2 Type and Th1 Type mediated diseases, acute and chronic pain (different forms of pain), and cancers such as lung, breast, stomach, bladder, colon, pancreas, ovarian, prostate and rectal cancer and hematopoietic malignancies (leukemia and lymphoma) Abetalipoproteinemia, Acrocyanosis, acute and chronic parasitic or infectious processes, acute leukemia, acute lymphoblastic leukemia (ALL), acute myeloid leukemia (AML), acute or chronic bacterial infection, acute pancreatitis, acute renal failure, adenocarcinomas, aerial ectopic beats, AIDS dementia complex, alcohol-induced hepatitis, allergic conjunctivitis, allergic contact dermatitis, allergic rhinitis, allograft rejection, alpha-1-antitrypsin deficiency, amyotrophic lateral sclerosis, anemia, angina pectoris, anterior horn cell degeneration, anti-CD3 therapy, antiphospholipid syndrome, anti-receptor hypersensitivity reactions, aortic and peripheral aneurysms, aortic dissection, arterial hypertension, arteriosclerosis, arteriovenous fistula, ataxia, atrial fibrillation (sustained or paroxysmal), atrial flutter, atrioventricular block, B cell lymphoma, bone graft rejection, bone marrow transplant (BMT) rejection, bundle branch block, Burkitt's lymphoma, Burns, cardiac arrhythmias, cardiac stun syndrome, cardiac tumors, cardiomyopathy, cardiopulmonary bypass inflammation response, cartilage transplant rejection, cerebellar cortical degenerations, cerebellar disorders, chaotic or multifocal atrial tachycardia, chemotherapy associated disorders, chronic myelocytic leukemia (CML), chronic alcoholism, chronic inflammatory pathologies, chronic lymphocytic leukemia (CLL), chronic obstructive pulmonary disease (COPD), chronic salicylate intoxication, colorectal carcinoma, congestive heart failure, conjunctivitis, contact dermatitis, cor pulmonale, coronary artery disease, Creutzfeldt-Jakob disease, culture negative sepsis, cystic fibrosis, cytokine therapy associated disorders, Dementia pugilistica, demyelinating diseases, dengue hemorrhagic fever, dermatitis, dermatologic conditions, diabetes, diabetes mellitus, diabetic arteriosclerotic disease, Diffuse Lewy body disease, dilated congestive cardiomyopathy, disorders of the basal ganglia, Down's Syndrome in middle age, drug-induced movement disorders induced by drugs which block CNS dopamine receptors, drug sensitivity, eczema, encephalomyelitis, endocarditis, endocrinopathy, epiglottitis, Epstein-Barr virus infection, erythromelalgia, extrapyramidal and cerebellar disorders, familial hematophagocytic lymphohistiocytosis, fetal thymus implant rejection, Friedreich's ataxia, functional peripheral arterial disorders, fungal sepsis, gas gangrene, gastric ulcer, glomerular nephritis, graft rejection of any organ or tissue, gram negative sepsis, gram positive sepsis, granulomas due to intracellular organisms, hairy cell leukemia, Hallervorden-Spatz disease, Hashimoto's thyroiditis, hay fever, heart transplant rejection, hemachromatosis, hemodialysis, hemolytic uremic syndrome/thrombolytic thrombocytopenic purpura, hemorrhage, hepatitis (A), His bundle arrhythmias, HIV infection/HIV neuropathy, Hodgkin's disease, hyperkinetic movement disorders, hypersensitivity reactions, hypersensitivity pneumonitis, hypertension, hypokinetic movement disorders, hypothalamic-pituitary-adrenal axis evaluation, idiopathic Addison's disease, idiopathic pulmonary fibrosis, antibody mediated cytotoxicity, Asthenia, infantile spinal muscular atrophy, inflammation of the aorta, influenza a, ionizing radiation exposure, iridocyclitis/uveitis/optic neuritis, ischemia-reperfusion injury, ischemic stroke, juvenile rheumatoid arthritis, juvenile spinal muscular atrophy, Kaposi's sarcoma, kidney transplant rejection, legionella, leishmaniasis, leprosy, lesions of the corticospinal system, lipedema, liver transplant rejection, lymphedema, malaria, malignant Lymphoma, malignant histiocytosis, malignant melanoma, meningitis, meningococcemia, metabolic/idiopathic, migraine headache, mitochondrial multi-system disorder, mixed connective tissue disease, monoclonal gammopathy, multiple myeloma, multiple systems degenerations (Mencel Dejerine-Thomas Shi-Drager and Machado-Joseph), myasthenia gravis, mycobacterium avium intracellulare, mycobacterium tuberculosis, myelodysplastic syndrome, myocardial infarction, myocardial ischemic disorders, nasopharyngeal carcinoma, neonatal chronic lung disease, nephritis, nephrosis, neurodegenerative diseases, neurogenic I muscular atrophies, neutropenic fever, non-Hodgkins lymphoma, occlusion of the abdominal aorta and its branches, occlusive arterial disorders, OKT3® therapy, orchitis/epidydimitis, orchitis/vasectomy reversal procedures, organomegaly, osteoporosis, pancreas transplant rejection, pancreatic carcinoma, paraneoplastic syndrome/hypercalcemia of malignancy, parathyroid transplant rejection, pelvic inflammatory disease, perennial rhinitis, pericardial disease, peripheral atherosclerotic disease, peripheral vascular disorders, peritonitis, pernicious anemia, pneumocystis carinii pneumonia, pneumonia, POEMS syndrome (polyneuropathy, organomegaly, endocrinopathy, monoclonal gammopathy, and skin changes syndrome), post perfusion syndrome, post pump syndrome, post-MI cardiotomy syndrome, preeclampsia, Progressive supranucleo Palsy, primary pulmonary hypertension, radiation therapy, Raynaud's phenomenon and disease, Raynaud's disease, Refsum's disease, regular narrow QRS tachycardia, renovascular hypertension, reperfusion injury, restrictive cardiomyopathy, sarcomas, scleroderma, senile chorea, Senile Dementia of Lewy body type, seronegative arthropathies, shock, sickle cell anemia, skin allograft rejection, skin changes syndrome, small bowel transplant rejection, solid tumors, specific arrhythmias, spinal ataxia, spinocerebellar degenerations, streptococcal myositis, structural lesions of the cerebellum, Subacute sclerosing panencephalitis, Syncope, syphilis of the cardiovascular system, systemic anaphylaxis, systemic inflammatory response syndrome, systemic onset juvenile rheumatoid arthritis, T-cell or FAB ALL, Telangiectasia, thromboangitis obliterans, thrombocytopenia, toxicity, transplants, trauma/hemorrhage, type III hypersensitivity reactions, type IV hypersensitivity, unstable angina, uremia, urosepsis, urticaria, valvular heart diseases, varicose veins, vasculitis, venous diseases, venous thrombosis, ventricular fibrillation, viral and fungal infections, viral encephalitis/aseptic meningitis, viral-associated hemaphagocytic syndrome, Wernicke-Korsakoff syndrome, Wilson's disease, xenograft rejection of any organ or tissue, acute coronary syndromes, acute idiopathic polyneuritis, acute inflammatory demyelinating polyradiculoneuropathy, acute ischemia, adult Still's disease, alopecia greata, anaphylaxis, anti-phospholipid antibody syndrome, aplastic anemia, arteriosclerosis, atopic eczema, atopic dermatitis, autoimmune dermatitis, autoimmune disorder associated with *streptococcus* infection, autoimmune enteropathy, autoimmune hearing loss, autoimmune lymphoproliferative syndrome (ALPS), autoimmune myocarditis, autoimmune premature ovarian failure, blepharitis, bronchiectasis, bullous pemphigoid, cardiovascular disease, catastrophic antiphospholipid syndrome, celiac disease, cervical spondylosis, chronic ischemia, cicatricial pemphigoid, clinically isolated syndrome (cis) with risk for multiple sclerosis, conjunctivitis, childhood onset psychiatric disorder, chronic obstructive pulmonary disease (COPD), dacryocystitis, dermatomyositis, diabetic retinopathy, diabetes mellitus, disk herniation, disk prolapse, drug induced immune hemolytic anemia, endocarditis, endometriosis, endophthalmitis, episcleritis, erythema multiforme, erythema multiforme major, gestational pemphigoid, Guillain-Barré syndrome (GBS), hay fever, Hughes syndrome, idiopathic Parkinson's disease, idiopathic interstitial pneumonia, IgE-mediated allergy, immune hemolytic anemia, inclusion body myositis, infectious ocular inflammatory disease, inflammatory demyelinating disease, inflammatory heart disease, inflammatory kidney disease, IPF/UIP, iritis, keratitis, keratojunctivitis sicca, Kussmaul disease or Kussmaul-Meier disease, Landry's paralysis, Langerhan's cell histiocytosis, livedo reticularis, macular degeneration, microscopic polyangiitis, morbus bechterev, motor neuron disorders, mucous membrane pemphigoid, multiple organ failure, myasthenia gravis, myelodysplastic syndrome, myocarditis, nerve root disorders, neuropathy, non-A non-B hepatitis, optic neuritis, osteolysis, ovarian cancer, pauciarticular JRA, peripheral artery occlusive disease (PAOD), peripheral vascular disease (PVD), peripheral artery, disease (PAD), phlebitis, polyarteritis nodosa (or periarteritis nodosa), polychondritis, polymyalgia rheumatica, poliosis, polyarticular JRA, polyendocrine deficiency syndrome, polymyositis, polymyalgia rheumatica (PMR), post-pump syndrome, primary Parkinsonism, prostate and rectal cancer and hematopoietic malignancies (leukemia and lymphoma), prostatitis, pure red cell aplasia, primary adrenal insufficiency, recurrent neuromyelitis optica, restenosis, rheumatic heart disease, sapho (synovitis, acne, pustulosis, hyperostosis, and osteitis), scleroderma, secondary amyloidosis, shock lung, scleritis, sciatica, secondary adrenal insufficiency, silicone associated connective tissue disease, sneddon-wilkinson dermatosis, spondylitis ankylosans, Stevens-Johnson syndrome (SJS), systemic inflammatory response syndrome, temporal arteritis, toxoplasmic retinitis, toxic epidermal necrolysis, transverse myelitis, TRAPS (tumor necrosis factor receptor, type 1 allergic reaction, type II diabetes, urticaria, usual interstitial pneumonia (UIP), vasculitis, vernal conjunctivitis, viral retinitis, Vogt-Koyanagi-Harada syndrome (VKH syndrome), wet macular degeneration, wound healing, or yersinia and salmonella associated arthropathy.

Another embodiment provides a method for treating a subject for a disease or a disorder in which SOST activity is detrimental by administering to the subject a sclerostin binding protein described herein such that treatment is achieved. The method can be used to a treat respiratory disorders; asthma; allergic and nonallergic asthma; asthma due to infection; asthma due to infection with respiratory syncytial virus (RSV); chronic obstructive pulmonary disease (COPD); other conditions involving airway inflammation; eosinophilia; fibrosis and excess mucus production; cystic fibrosis; pulmonary fibrosis; atopic disorders; atopic dermatitis; urticaria; eczema; allergic rhinitis; and allergic enterogastritis; inflammatory and/or autoimmune conditions of the skin; inflammatory and/or autoimmune conditions of gastrointestinal organs; inflammatory bowel diseases (IBD); ulcerative colitis; Crohn's disease; inflammatory and/or autoimmune conditions of the liver; liver cirrhosis; liver fibrosis; liver fibrosis caused by hepatitis B and/or C virus; scleroderma; tumors or cancers; hepatocellular carcinoma; glioblastoma; lymphoma; Hodgkin's lymphoma; viral infections; HTLV-1 infection (e.g., from HTLV-1); suppression of expression of protective type 1 immune responses, or suppression of expression of protective type 1 immune responses during vaccination.

In a further embodiment of the above method, the administering to the subject is by parenteral, subcutaneous, intramuscular, intravenous, intra-articular, intrabronchial, intraabdominal, intracapsular, intracartilaginous, intracavitary, intracelial, intracerebellar, intracerebroventricular, intracolic, intracervical, intragastric, intrahepatic, intramyocardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravesical, bolus, vaginal, rectal, buccal, sublingual, intranasal, or transdermal.

A method of treating a patient suffering from a disorder in which sclerostin is detrimental comprising the step of administering asclerostin binding protein described herein before, concurrent with, or after the administration of a second agent is provided, wherein the second agent is inhaled steroids; beta-agonists; short-acting or long-acting beta-agonists; antagonists of leukotrienes or leukotriene receptors; ADVAIR; IgE inhibitors; anti-IgE antibodies; XOLAIR; phosphodiesterase inhibitors; PDE4 inhibitors; xanthines; anticholinergic drugs; mast cell-stabilizing agents; Cromolyn; IL-4 inhibitors; IL-5 inhibitors; eotaxin/CCR3 inhibitors; antagonists of histamine or its receptors including H1, H2, H3, and H4; antagonists of prostaglandin D or its receptors DP1 and CRTH2; TNF antagonists; a soluble fragment of a TNF receptor; ENBREL®; TNF enzyme antagonists; TNF converting enzyme (TACE) inhibitors; muscarinic receptor antagonists; TGF-beta antagonists; interferon gamma; perfenidone; chemotherapeutic agents, methotrexate; leflunomide; sirolimus (rapamycin) or an analog thereof, CCI-779; COX2 or cPLA2 inhibitors; NSAIDs; immunomodulators; p38 inhibitors; TPL-2, MK-2 and NFkB inhibitors; budenoside; epidermal growth factor; corticosteroids; cyclosporine; sulfasalazine; aminosalicylates; 6-mercaptopurine; azathioprine; metronidazole; lipoxygenase inhibitors; mesalamine; olsalazine; balsalazide; antioxidants; thromboxane inhibitors; IL-1 receptor antagonists; anti-IL-1β antibodies; anti-IL-6 antibodies; growth factors; elastase inhibitors; pyridinyl-imidazole compounds; antibodies or agonists of TNF, LT, IL-1, IL-2, IL-3, IL-4, IL-5, IL-6, IL-7, IL-8, IL-9, IL-10, IL-11, IL-12, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, EMAP-II, GM-CSF, FGF, or PDGF; antibodies of CD2, CD3, CD4, CD8, CD25, CD28, CD30, CD40, CD45, CD69, CD90 or their ligands; FK506; rapamycin; mycophenolate mofetil; ibuprofen; prednisolone; phosphodiesterase inhibitors; adensosine agonists; anti-thrombotic agents; complement inhibitors; adrenergic agents; IRAK, NIK, IKK, p38, or MAP kinase inhibitors; IL-1β converting enzyme inhibitors; TNF-α converting enzyme inhibitors; T-cell signaling inhibitors; metalloproteinase inhibitors; 6-mercaptopurines; angiotensin converting enzyme inhibitors; soluble cytokine receptors; soluble p55 TNF receptor; soluble p75 TNF receptor; sIL-IR1; sIL-1RII; sIL-6R; anti-inflammatory cytokines; IL-4; IL-10; IL-11; SOST; or TGF-β.

BRIEF DESCRIPTION OF THE DRAWINGS

FIG. 1A is a schematic representation of Dual Variable Domain (DVD) constructs and shows the strategy for generation of a DVD-binding protein from two parent antibodies.

FIG. 1B is a schematic representation of constructs DVD1-Ig, DVD2-Ig, and two chimeric mono-specific antibody clones.

FIG. 2 demonstrates the effect of anti-TNF, anti-sclerostin, or combined therapies on paw swelling in a mouse model of induced arthritis.

FIG. 4 shows the combined neutralization of TNF and SOST in a late therapeutic mouse collagen induced arthritis (CIA) model in which therapy began five days after the onset of inflammation. FIG. 4B shows the arthritic ankle bone volume when dosed with anti-mouse TNF mAb, anti-sclerostin mAb, or a combination of both anti-mouse TNF mAb and anti-sclerostin mAb.

FIG. 5 shows the ability of sclerostin inhibition to restore bone in the arthritic joint in mice in which therapy began five days after the onset of inflammation. FIG. 5B shows the arthritic ankle bone volume when dosed with an anti-IL1β therapeutic and an anti-IL1β therapeutic, anti-sclerostin, or a combination of an anti-IL1β therapeutic and an anti-IL1β therapeutic and anti-sclerostin.

FIG. 6 shows data from a mouse model of Crohn's disease.

FIGS. 7A-1, 7A-2, 7B-1, and 7B-2 show binding profile data which demonstrate that exemplary Sclerostin/TNF DVD-Igs bind sclerostin once saturated with TNF and vice versa.

DETAILED DESCRIPTION OF THE INVENTION

Figure 1:
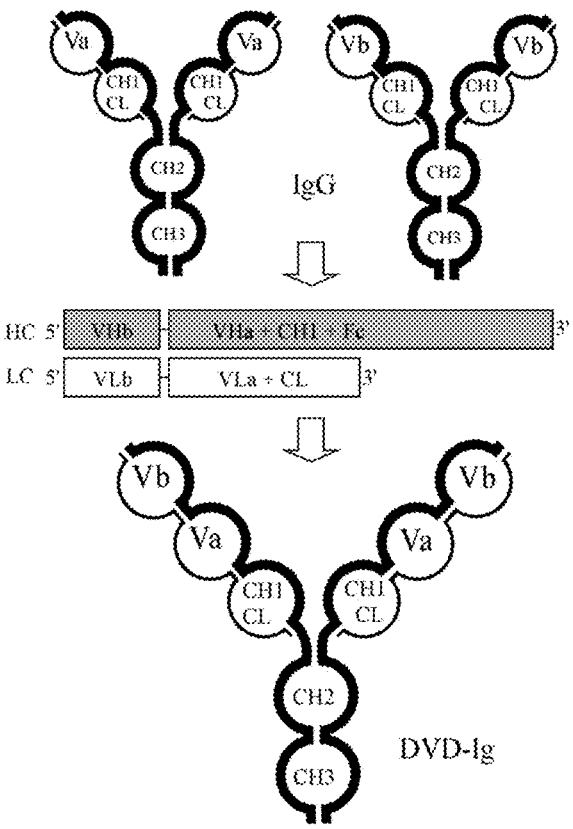
Figure 1:
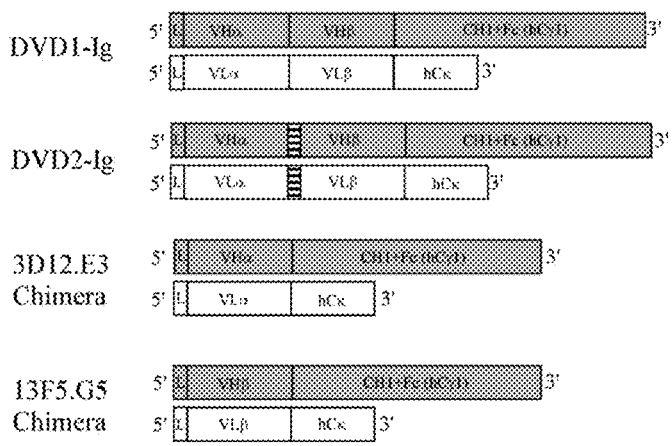

Sclerostin binding proteins, including, but not limited to, anti-sclerostin antibodies, or antigen-binding portions thereof, that bind sclerostin and multivalent, multispecific binding proteins such as DVD-binding proteins that bind SOST and another target are provided. Various aspects relating to antibodies and antibody fragments, DVD-binding proteins, and pharmaceutical compositions thereof, as well as nucleic acids, recombinant expression vectors and host cells for making such sclerostin binding proteins, including antibodies, DVD-binding proteins, and fragments thereof are provided. Methods of using the sclerostin binding proteins to detect human sclerostin, either in vitro or in vivo; and to regulate gene expression are also provided.

Any binding protein or antibody capable of competing with a sclerostin binding protein described herein are also provided.

Unless otherwise defined herein, scientific and technical terms shall have the meanings that are commonly understood by those of ordinary skill in the art. The meaning and scope of the terms should be clear, however, in the event of any latent ambiguity, definitions provided herein take precedence over any dictionary or extrinsic definition. Further, unless otherwise required by context, singular terms shall include pluralities and plural terms shall include the singular. In this application, the use of "or" means "and/or" unless stated otherwise. Furthermore, the use of the term "including", as well as other forms, such as "includes" and "included", is not limiting. Also, terms such as "element" or "component" encompass both elements and components comprising one unit and elements and components that comprise more than one subunit unless specifically stated otherwise.

Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques provided are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

That what is provided may be more readily understood, select terms are defined below.

The term "polypeptide" refers to any polymeric chain of amino acids. The terms "peptide" and "protein" are used interchangeably with the term polypeptide and also refer to a polymeric chain of amino acids. The term "polypeptide" encompasses native or artificial proteins, protein fragments and polypeptide analogs of a protein sequence. A polypeptide may be monomeric or polymeric. Use of "polypeptide" herein is intended to encompass polypeptide and fragments and variants (including fragments of variants) thereof, unless otherwise contradicted by context. For an antigenic polypeptide, a fragment of polypeptide optionally contains at least one contiguous or nonlinear epitope of polypeptide. The precise boundaries of the at least one epitope fragment can be confirmed using ordinary skill in the art. The fragment comprises at least about 5 contiguous amino acids, such as at least about 10 contiguous amino acids, at least about 15 contiguous amino acids, or at least about 20 contiguous amino acids. A variant of polypeptide is as described herein.

The term "isolated protein" or "isolated polypeptide" refers to a protein or polypeptide that by virtue of its origin or source of derivation is not associated with naturally associated components that accompany it in its native state; is substantially free of other proteins from the same species; is expressed by a cell from a different species; or does not occur in nature. Thus, a polypeptide that is chemically synthesized or synthesized in a cellular system different from the cell from which it naturally originates will be "isolated" from its naturally associated components. A protein may also be rendered substantially free of naturally associated components by isolation, using protein purification techniques well known in the art.

The term "recovering" refers to the process of rendering a chemical species such as a polypeptide substantially free of naturally associated components by isolation, e.g., using protein purification techniques well known in the art.

The terms "human sclerostin" or "human SOST" (abbreviated herein as "hSOST") refer to a 24 KD protein, or active fragments thereof, called sclerostin that has been classified as a member of the DAN family of cysteine knot containing glycoproteins based on sequence similarity (Avasian-Kretchmer (2004) Mol. Endocrinol. 8(1):1-12). Sclerostin is a negative regulator of bone formation that inhibits osteoblast proliferation as well as differentiation and suppresses mineralization of osteoblastic cells in vitro (Poole et al. (2005) FASEB J. 19:1836-38; Winkler et al. (2005) J. Biol. Chem. 280(4): 2498-2502). The term human "SOST" is intended to include recombinant human sclerostin (rhSOST) which can be prepared by standard recombinant expression methods. The sequence of human SOST is shown in Table 2.

TABLE 2

Sequence of Human Sclerostin

| Protein | Sequence Identifier | Sequence<br>12345678901234567890123456 7890 |
|---|---|---|
| Human Sclerostin | SEQ ID NO.: 1694 | QGWQAFKNDATEIIPELGEYPEPPPELENNKTMNRAE<br>NGGRPPHHPFETKDVSEYSCREL<br>HFTRYVTDGPCRSAKPVTELVCSGQCGPARLLPNAIG<br>RGKWWRPSGPDFRCIPDRYRAQR<br>VQLLCPGGEAPRARKVRLVASCKCKRLTRFHNQSELK<br>DFGTEAARPQKGRKPRPRARSAK<br>ANQAELENAY |

"Biological activity" refers to all inherent biological properties of the cytokine. Biological properties of sclerostin include, but are not limited to, binding to an sclerostin receptor.

The terms "specific binding" or "specifically binding" in reference to the interaction of an antibody, a protein, or a peptide with a second chemical species, mean that the interaction is dependent upon the presence of a particular structure (e.g., an antigenic determinant or epitope) on the chemical species; for example, an antibody recognizes and binds to a specific protein structure rather than to proteins generally. If an antibody is specific for epitope "A", the presence of a molecule containing epitope A (or free, unlabeled A), in a reaction containing labeled "A" and the antibody, will reduce the amount of labeled A bound to the antibody.

The term "antibody" broadly refers to any immunoglobulin (Ig) molecule comprised of four polypeptide chains, two heavy (H) chains and two light (L) chains, or any functional fragment, mutant, variant, or derivation thereof, which retains the essential epitope binding features of an Ig molecule. Such mutant, variant, or derivative antibody formats are known in the art. Nonlimiting embodiments of which are discussed below.

In a full-length antibody, each heavy chain is comprised of a heavy chain variable region (abbreviated herein as HCVR or VH) and a heavy chain constant region. The heavy chain constant region is comprised of three domains: CH1, CH2, and CH3. Each light chain is comprised of a light chain variable region (abbreviated herein as LCVR or VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. Immunoglobulin molecules can be of any type (e.g., IgG, IgE, IgM, IgD, IgA and IgY), class (e.g., IgG1, IgG2, IgG3, IgG4, IgA1 and IgA2) or subclass.

The term "Fc region" is used to define the C-terminal region of an immunoglobulin heavy chain, which may be generated by papain digestion of an intact antibody. The Fc region may be a native sequence Fc region or a variant Fc region. The Fc region of an immunoglobulin generally comprises two constant domains, a CH2 domain, and a CH3 domain, and optionally comprises a CH4 domain. Replacements of amino acid residues in the Fc portion to alter antibody effector function are known in the art (U.S. Pat. Nos. 5,648,260 and 5,624,821). The Fc portion of an antibody mediates several important effector functions, for example, cytokine induction, ADCC, phagocytosis, complement dependent cytotoxicity (CDC), and half-life/clearance rate of antibody and antigen-antibody complexes. In some cases these effector functions are desirable for therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies. In still another embodiment at least one amino acid residue is replaced in the constant region of the antibody, for example the Fc region of the antibody, such that effector functions of the antibody are altered. The dimerization of two identical heavy chains of an immunoglobulin is mediated by the dimerization of CH3 domains and is stabilized by the disulfide bonds within the hinge region (Huber et al. Nature 264:415-20; Thies et al. (1999) J. Mol. Biol. 293:67-79.). Mutation of cysteine residues within the hinge regions to prevent heavy chain-heavy chain disulfide bonds will destabilize dimeration of CH3 domains. Residues responsible for CH3 dimerization have been identified (Dall'Acqua (1998) Biochem. 37:9266-9273.). Therefore, it is possible to generate a monovalent half-Ig. Interestingly, these monovalent half Ig molecules have been found in nature for both IgG and IgA subclasses (Seligman (1978) Ann. Immunol. 129:855-70; Biewenga et al. (1983) Clin. Exp. Immunol. 51: 395-400). The stoichiometry of FcRn: Ig Fc region has been determined to be 2:1 (West et al. (2000) Biochem. 39: 9698-708), and half Fc is sufficient for mediating FcRn binding (Kim et al. (1994) Eur. J. Immunol. 24: 542-548). Mutations to disrupt the dimerization of CH3 domain may not have greater adverse effect on its FcRn binding as the residues important for CH3 dimerization are located on the inner interface of CH3 b sheet structure, whereas the region responsible for FcRn binding is located on the outside interface of CH2-CH3 domains. However, the half Ig molecule may have certain advantage in tissue penetration due to its smaller size than that of a regular antibody. In one provided embodiment, at least one amino acid residue is replaced in the constant region of the binding protein, for example the Fc region, such that the dimerization of the heavy chains is disrupted, resulting in half DVD Ig molecules. The anti-inflammatory activity of IgG is completely dependent on sialylation of the N-linked glycan of the IgG Fc fragment. The precise glycan requirements for anti-inflammatory activity has been determined, such that an appropriate IgG1 Fc fragment can be created, thereby generating a fully recombinant, sialylated IgG1 Fc with greatly enhanced potency (Anthony et al. (2008) Science 320:373-376).

The term "antigen-binding portion" of an antibody (or simply "antibody portion") refers to one or more fragments of an antibody that retain the ability to specifically bind to an antigen (e.g., human sclerostin (hSOST)). It has been shown that the antigen-binding function of an antibody can be performed by fragments of a full-length antibody. Such antibody embodiments may also be bispecific, dual specific, or multi-specific formats; specifically binding to two or more different antigens. Examples of binding fragments encompassed within the term "antigen-binding portion" of an antibody include (i) a Fab fragment, a monovalent fragment consisting of the VL, VH, CL, and CH1 domains; (ii) a F(ab')$_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al. (1989) Nature 341:544-546, PCT Publication No. WO 90/05144), which comprises a single variable domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see, for example, Bird et al. (1988) Science 242: 423-426 and Huston et al. (1988) Proc. Natl. Acad. Sci. USA 85: 5879-5883). Such single chain antibodies are also intended to be encompassed within the term "antigen-binding portion" of an antibody. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see, for example, Holliger, et al. (1993) Proc. Natl. Acad. Sci. USA 90: 6444-6448; Poljak et al. (1994) Structure 2: 1121-1123). Such antibody binding portions are known in the art (Kontermann and Dubel eds., Antibody Engineering (2001) Springer-Verlag. New York. 790 pp. (ISBN 3-540-41354-5)). In addition single chain antibodies also include "linear antibodies" comprising a pair of tandem Fv segments (VH-CH1-VH-CH1) which, together with complementary light chain polypeptides, form a pair of antigen binding regions (Zapata et al. (1995) Protein Eng. 8(10): 1057-1062; and U.S. Pat. No. 5,641,870).

An immunoglobulin constant (C) domain refers to a heavy (CH) or light (CL) chain constant domain. Murine and human IgG heavy chain and light chain constant domain amino acid sequences are known in the art.

The term "binding protein construct" refers to a polypeptide comprising one or more of the antigen binding portions linked to a linker polypeptide or an immunoglobulin constant domain. Linker polypeptides comprise two or more amino acid residues joined by peptide bonds and are used to link one or more antigen binding portions. Such linker polypeptides are well known in the art (see e.g., Holliger et al. (1993) Proc. Natl. Acad. Sci. USA 90: 6444-6448; Poljak et al. (1994) Structure 2: 1121-1123). An immunoglobulin constant domain refers to a heavy or light chain constant domain. Human IgG heavy chain and light chain constant domain amino acid sequences are provided in Table 3.

The VH and VL domain sequences provided below comprise complementarity determining region (CDR) and framework sequences that are either known in the art or readily discernable using methods known in the art. In some embodiments, one or more of these CDR and/or framework sequences are replaced, without loss or function, by other CDR and/or framework sequences from binding proteins that are known in the art to bind to the same antigen.

TABLE 3

Sequence of Human IgG Heavy Chain Constant Domain and Light Chain Constant Domain

| Protein | Sequence Identifier | Sequence 123456789012345678901234567890 |
|---|---|---|
| Ig gamma-1 constant region | SEQ ID NO.: 2060 | ASTKGPSVFFLAPSSKSTSGGTAALGCLVKDYFPEPV TVSWNSGALTSGVHTFPPAVLQSSGLYSLSSVVTVPSS SLGTQTYICNVNHKPSNTKVDKKVEPKSCDKTHTCPP CPAPELLGGPSVFLFPPKPKDTLMISRTPEVTCVVVD VSHEDPEVKFNWYVDGVEVHNAKTKPREEQYNSTYRV VSVLTVLHQDWLNGKEYKCKVSNKALPAPIEKTISKA KGQPREPQVYTLPPSREEMTKNQVSLTCLVKGFYPSD IAVEWESNGQPENNYKTTPPVLDSDGSFFLYSKLTVD KSRWQQGNVFSCSVMHEALHNHYTQKSLSLSPGK |
| Ig gamma-1 constant region QL | SEQ ID NO.: 2061 | ASTKGPSVFPLAPSSKSTSGGTAALGCLVKDYFPEPV TVSWNSGALTSGVHTFPPAVLQSSGLYSLSSVVTVPSS SLGTQTYICNVNHKPSNTKVDKKVEPKSCDKTHTCPP CPAPELLGGPSVFLFPPKPKDQLMISRTPEVTCVVVD VSHEDPEVKFNWYVDGVEVHNAKTKPREEQYNSTYRV VSVLTVLHQDWLNGKEYKCKVSNKALPAPIEKTISKA KGQPREPQVYTLPPSREEMTKNQVSLTCLVKGFYPSD IAVEWESNGQPENNYKTTPPVLDSDGSFFLYSKLTVD KSRWQQGNVFSCSVLHEALHNHYTQKSLSLSPGK |
| Ig gamma-1 constant region mutant | SEQ ID NO.: 2062 | ASTKGPSVFPLAPSSKSTSGGTAALGCLVKDYFPEPV TVSWNSGALTSGVHTFPPAVLQSSGLYSLSSVVTVPSS SLGTQTYICNVNHKPSNTKVDKKVEPKSCDKTHTCPP CPAPEAAGGPSVFLFPPKPKDTLMISRTPEVTCVVVD VSHEDPEVKFNWYVDGVEVHNAKTKPREEQYNSTYRV VSVLTVLHQDWLNGKEYKCKVSNKALPAPIEKTISKA KGQPREPQVYTLPPSREEMTKNQVSLTCLVKGFYPSD IAVEWESNGQPENNYKTTPPVLDSDGSFFLYSKLTVD KSRWQQGNVFSCSVMHEALHNHYTQKSLSLSPGK |

TABLE 3-continued

Sequence of Human IgG Heavy Chain Constant Domain and Light Chain Constant Domain

| Protein | Sequence Identifier | Sequence<br>1234567890123456789012345678 90 |
|---|---|---|
| Ig gamma-1 constant region QL mutant | SEQ ID NO.: 2063 | ASTKGPSVFPLAPSSKSTSGGTAALGCLVKDYFPEPV TVSWNSGALTSGVHTFPAVLQSSGLYSLSSVVTVPSS SLGTQTYICNVNHKPSNTKVDKKVEPKSCDKTHTCPP CPAPEAAGGPSVFLFPPKPKDQLMISRTPEVTCVVVD VSHEDPEVKFNWYVDGVEVHNAKTKPREEQYNSTYRV VSVLTVLHQDWLNGKEYKCKVSNKALPAPIEKTISKA KGQPREPQVYTLPPSREEMTKNQVSLTCLVKGFYPSD IAVEWESNGQPENNYKTTPPVLDSDGSFFLYSKLTVD KSRWQQGNVFSCSVLHEALHNHYTQKSLSLSPGK |
| Ig Kappa constant region | SEQ ID NO.: 2064 | TVAAPSVFIFPPSDEQLKSGTASVVCLLNNFYPREAK VQWKVDNALQSGNSQESVTEQDSKDSTYSLSSTLTLS KADYEKHKVYACEVTHQGLSSPVTKSFNRGEC |
| Ig Lambda constant region | SEQ ID NO.: 2065 | QPKAAPSVTLFPPSSEELQANKATLVCLISDFYPGAV TVAWKADSSPVKAGVETTTPSKQSNNKYAASSYLSLT PEQWKSHRSYSCQVTHEGSTVEKTVAPTECS |

Still further, a sclerostin binding protein, such as an antibody or antigen-binding portion thereof, may be part of a larger immunoadhesion molecule, formed by covalent or noncovalent association of the antibody or antibody portion with one or more other proteins or peptides. Examples of such immunoadhesion molecules include use of the streptavidin core region to make a tetrameric scFv molecule (Kipriyanov et al. (1995) Human Antibod. Hybridomas 6: 93-101) and use of a cysteine residue, a marker peptide and a C-terminal polyhistidine tag to make bivalent and biotinylated scFv molecules (Kipriyanov et al. (1994) Mol. Immunol. 31: 1047-1058). Antibody portions, such as Fab and F(ab')$_2$ fragments, can be prepared from whole antibodies using conventional techniques, such as papain or pepsin digestion, respectively, of whole antibodies. Moreover, antibodies, antibody portions and immunoadhesion molecules can be obtained using standard recombinant DNA techniques, as described herein.

The term "isolated antibody" refers to an antibody that is substantially free of other antibodies having different antigenic specificities (e.g., an isolated antibody that specifically binds hSOST is substantially free of antibodies that specifically bind antigens other than hSOST). An isolated antibody that specifically binds hSOST may, however, have cross-reactivity to other antigens, such as sclerostin molecules from other species. Moreover, an isolated antibody may be substantially free of other cellular material and/or chemicals.

The term "monoclonal antibody" or "mAb" refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigen. Furthermore, in contrast to polyclonal antibody preparations that typically include different antibodies directed against different determinants (epitopes), each mAb is directed against a single determinant on the antigen. The modifier "monoclonal" is not to be construed as requiring production of the antibody by any particular method.

The term "human antibody" is intended to include antibodies having variable and constant regions derived from human germline immunoglobulin sequences. Human antibodies are provided and may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody" is not intended to include antibodies in which CDR sequences derived from the germline of another mammalian species, such as a mouse, have been grafted onto human framework sequences.

The term "recombinant human antibody" is intended to include all human antibodies that are prepared, expressed, created or isolated by recombinant means, such as antibodies expressed using a recombinant expression vector transfected into a host cell (described further in Section II C, below), antibodies isolated from a recombinant, combinatorial human antibody library (Hoogenboom (1997) TIB Tech. 15:62-70; Azzazy and Highsmith (2002) Clin. Biochem. 35: 425-445; Gavilondo and Larrick (2002) BioTechniques 29: 128-145; Hoogenboom and Chames (2000) Immunol. Today 21: 371-378), antibodies isolated from an animal (e.g., a mouse) that is transgenic for human immunoglobulin genes (see, e.g., Taylor et al. (1992) Nucl. Acids Res. 20:6287-6295; Kellermann and Green (2002) Curr. Opin. Biotechnol. 13:593-597; Little et al (2000) Immunol. Today 21: 364-370) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

The term "chimeric antibody" refers to antibodies that comprise heavy and light chain variable region sequences from one species and constant region sequences from another species, such as antibodies having murine heavy and light chain variable regions linked to human constant regions.

The term "CDR-grafted antibody" refers to antibodies that comprise heavy and light chain variable region sequences from one species but in which the sequences of one or more of the CDR regions of VH and/or VL are replaced with CDR sequences of another species, such as antibodies having murine heavy and light chain variable regions in which one or more of the murine CDRs (e.g., CDR3) has been replaced with human CDR sequences.

The terms "Kabat numbering", "Kabat definitions", and "Kabat labeling" are used interchangeably herein. These terms, which are recognized in the art, refer to a system of numbering amino acid residues which are more variable (i.e., hypervariable) than other amino acid residues in the heavy and light chain variable regions of an antibody, or an antigen binding portion thereof (Kabat et al. (1971) Ann. NY Acad. Sci. 190:382-391 and Kabat, E. A., et al. (1991) Sequences of Proteins of Immunological Interest, Fifth Edition, U.S. Department of Health and Human Services, NIH Publication No. 91-3242). For the heavy chain variable region, the hypervariable region ranges from amino acid positions 31 to 35 for CDR1, amino acid positions 50 to 65 for CDR2, and amino acid positions 95 to 102 for CDR3. For the light chain variable region, the hypervariable region ranges from amino acid positions 24 to 34 for CDR1, amino acid positions 50 to 56 for CDR2, and amino acid positions 89 to 97 for CDR3.

The term "CDR" refers to the complementarity determining region within antibody variable sequences. There are three CDRs in each of the variable regions of the heavy chain and the light chain, which are designated CDR1, CDR2 and CDR3, for each of the variable regions. The term "CDR set" refers to a group of three CDRs that occur in a single variable region capable of binding the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia and Lesk (1987) J. Mol. Biol. 196:901-917 and Chothia et al. (1989) Nature 342:877-883) found that certain sub-portions within Kabat CDRs adopt nearly identical peptide backbone conformations, despite having great diversity at the level of amino acid sequence. These sub-portions were designated as L1, L2, and L3 or H1, H2, and H3 where the "L" and the "H" designates the light chain and the heavy chains regions, respectively. These regions may be referred to as Chothia CDRs, which have boundaries that overlap with Kabat CDRs. Other boundaries defining CDRs overlapping with the Kabat CDRs have been described by Padlan (1995). The methods used herein may utilize CDRs defined according to any of these systems, although certain embodiments use Kabat or Chothia defined CDRs.

The term "canonical residue" refers to a residue in a CDR or framework that defines a particular canonical CDR structure as defined by Chothia et al. (1987) J. Mol. Biol. 196:901-907; Chothia et al. (1992) J. Mol. Biol. 227:799). According to Chothia et al., critical portions of the CDRs of many antibodies have nearly identical peptide backbone confirmations despite great diversity at the level of amino acid sequence. Each canonical structure specifies primarily a set of peptide backbone torsion angles for a contiguous segment of amino acid residues forming a loop.

An "affinity matured" antibody is an antibody with one or more alterations in one or more CDRs thereof which result in an improvement in the affinity of the antibody for a target antigen, compared to a parent antibody which does not possess the alteration(s). Exemplary affinity matured antibodies will have nanomolar or even picomolar affinities for the target antigen. A variety of procedures for producing affinity matured antibodies are known in the art. For example, Marks et al. (1992) Bio/Technol. 10: 779-783 describes affinity maturation by VH and VL domain shuffling. Random mutagenesis of CDR and/or framework residues is described by Barbas et al. (1994) Proc. Nat. Acad. Sci. USA 91:3809-3813; Schier et al. (1995) Gene 169:147-155; Yelton et al. (1995) J. Immunol. 155:1994-2004; Jackson et al. (1995) J. Immunol. 154(7):3310-3319; Hawkins et al. (1992) J. Mol. Biol. 226:889-896. Selective mutation at selective mutagenesis positions and at contact or hypermutation positions with an activity enhancing amino acid residue is described in U.S. Pat. No. 6,914,128.

The term "multivalent binding protein" denotes a binding protein comprising two or more antigen binding sites. In an embodiment, multivalent binding protein is engineered to have three or more antigen binding sites, and is generally not a naturally occurring antibody. The term "multispecific binding protein" refers to a binding protein capable of binding two or more related or unrelated targets. "Dual variable domain" ("DVD") binding proteins are provided and comprise two or more antigen binding sites and are tetravalent or multivalent binding proteins. DVDs may be monospecific, i.e., capable of binding one antigen, or multispecific, i.e., capable of binding two or more antigens. A "DVD binding protein" comprises two heavy chain DVD polypeptides and two light chain DVD polypeptides. Each half of a DVD-binding protein comprises a heavy chain DVD polypeptide and a light chain DVD polypeptide, and two or more antigen binding sites. Each binding site comprises a heavy chain variable domain and a light chain variable domain with a total of six CDRs involved in antigen binding per antigen binding site. DVD binding proteins are also known as DVD-Ig™ molecules.

A description of the design, expression, and characterization of DVD-binding proteins is provided in PCT Publication No. WO 2007/024715, U.S. Pat. No. 7,612,181, and Wu et al. (2007) Nature Biotech. 25:1290-1297. An example of such DVD-binding proteins comprises a heavy chain that comprises the structural formula VD1-(X1)n-VD2-C—(X2)n, wherein VD1 is a first heavy chain variable domain, VD2 is a second heavy chain variable domain, C is a heavy chain constant domain, X1 is a linker with the proviso that it is not CH1, X2 is an Fc region, and n is 0 or 1, but, in an embodiment, 1; and a light chain that comprises the structural formula VD1-(X1)n-VD2-C—(X2)n, wherein VD1 is a first light chain variable domain, VD2 is a second light chain variable domain, C is a light chain constant domain, X1 is a linker with the proviso that it is not CL, and X2 does not comprise an Fc region; and n is 0 or 1, but, in an embodiment, 1. Such a DVD-binding protein may comprise two such heavy chains and two such light chains, wherein each chain comprises variable domains linked in tandem without an intervening constant region between variable regions, wherein a heavy chain and a light chain associate to form tandem functional antigen binding sites, and a pair of heavy and light chains may associate with another pair of heavy and light chains to form a tetrameric binding protein with four functional antigen binding sites. In another example, a DVD-binding protein may comprise heavy and light chains that each comprise three variable domains (VD1, VD2, VD3) linked in tandem without an intervening constant region between variable domains, wherein a pair of heavy and light chains may associate to form three antigen binding sites, and wherein a pair of heavy and light chains may associate with another pair of heavy and light chains to form a tetrameric binding protein with six antigen binding sites.

A DVD-binding protein may bind one or more epitopes of sclerostin. A DVD-binding protein may also bind an epitope of sclerostin and an epitope of a second target antigen other than a sclerostin polypeptide.

The term "bispecific antibody" refers to full-length antibodies that are generated by quadroma technology (see Milstein and Cuello (1983) Nature 305(5934):537-40), by chemical conjugation of two different monoclonal antibodies (see Staerz et al. (1985) Nature 314(6012): 628-31), or by knob-into-hole or similar approaches which introduces mutations in the Fc region (see Holliger et al. (1993) Proc. Natl. Acad. Sci. USA 90(14):6444-6448), resulting in multiple different immunoglobulin species of which only one is the functional bispecific antibody. By molecular function, a bispecific antibody binds one antigen (or epitope) on one of its two binding arms (one pair of HC/LC), and binds a different antigen (or epitope) on its second arm (a different pair of HC/LC). By this definition, a bispecific antibody has two distinct antigen binding arms (in both specificity and CDR sequences), and is monovalent for each antigen to which it binds.

The term "dual-specific antibody" refers to full-length antibodies that can bind two different antigens (or epitopes) in each of its two binding arms (a pair of HC/LC) (see PCT Publication No. WO 02/02773). Accordingly a dual-specific binding protein has two identical antigen binding arms, with identical specificity and identical CDR sequences, and is bivalent for each antigen to which it binds.

A "functional antigen binding site" of a binding protein is one that is capable of binding a target antigen. The antigen binding affinity of the antigen binding site is not necessarily as strong as the parent antibody from which the antigen binding site is derived, but the ability to bind antigen must be measurable using any one of a variety of methods known for evaluating antibody binding to an antigen. Moreover, the antigen binding affinity of each of the antigen binding sites of a multivalent antibody herein need not be quantitatively the same.

The term "cytokine" is a generic term for proteins that are released by one cell population and that act on another cell population as intercellular mediators. Examples of such cytokines are lymphokines, monokines, and traditional polypeptide hormones. Included among the cytokines are growth hormones, such as human growth hormone, N-methionyl human growth hormone, and bovine growth hormone; parathyroid hormone; thyroxine; insulin; proinsulin; relaxin; prorelaxin; glycoprotein hormones, such as follicle stimulating hormone (FSH), thyroid stimulating hormone (TSH), and luteinizing hormone (LH); hepatic growth factor; fibroblast growth factor; prolactin; placental lactogen; a tumor necrosis factor such as tumor necrosis factor-alpha (TNF-$\alpha$) and tumor necrosis factor-beta (TNF-$\beta$); mullerian-inhibiting substance; mouse gonadotropin-associated peptide; inhibin; activin; vascular endothelial growth factor; integrin; thrombopoietin (TPO); nerve growth factors such as NGF-alpha (NGF-$\alpha$); platelet-growth factor; placental growth factor; transforming growth factors (TGFs) such as TGF-alpha (TGF-$\alpha$) and TGF-beta (TGF-$\beta$); insulin-like growth factor-1 and -11; erythropoietin (EPO); osteoinductive factors; interferons such as interferon-alpha (IFN-$\alpha$), interferon-beta (IFN-$\beta$), and interferon-gamma (IFN-$\gamma$); colony stimulating factors (CSFs) such as macrophage-CSF (M-CSF); granulocyte macrophage-CSF (GM-CSF); and granulocyte-CSF (G-CSF); interleukins (ILs) such as IL-1, IL-2, IL-3, IL-4, IL-5, IL-6, IL-7, IL-8, IL-9, IL-10, IL-11, IL-12, IL-13, IL-15, IL-17, IL-18, IL-21, IL-22, IL-23, IL-33; and other polypeptide factors including LIF and kit ligand (KL). The term cytokine includes proteins from natural sources or from recombinant cell culture and biologically active equivalents of the native sequence cytokines.

The terms "donor" and "donor antibody" refer to an antibody providing one or more CDRs. In an embodiment, the donor antibody is an antibody from a species different from the antibody from which the framework regions are obtained or derived. In the context of a humanized antibody, the term "donor antibody" refers to a non-human antibody providing one or more CDRs.

The terms "framework" and "framework sequence" refers to the remaining sequences of a variable region minus the CDRs. Because the exact definition of a CDR sequence can be determined by different systems, the meaning of a framework sequence is subject to correspondingly different interpretations. The six CDRs (CDR-L1, -L2, and -L3 of light chain and CDR-H1, -H2, and -H3 of heavy chain) also divide the framework regions on the light chain and the heavy chain into four sub-regions (FR1, FR2, FR3 and FR4) on each chain, in which CDR1 is positioned between FR1 and FR2, CDR2 between FR2 and FR3, and CDR3 between FR3 and FR4. Without specifying the particular sub-regions as FR1, FR2, FR3 or FR4, a framework region, as referred by others, represents the combined FR's within the variable region of a single, naturally occurring immunoglobulin chain. An FR represents one of the four sub-regions, and FRs represents two or more of the four sub-regions constituting a framework region.

The terms "acceptor" and "acceptor antibody" refer to the antibody providing or nucleic acid sequence encoding at least 80%, at least 85%, at least 90%, at least 95%, at least 98%, or 100% of the amino acid sequences of one or more of the framework regions. In some embodiments, the term "acceptor" refers to the antibody amino acid providing or nucleic acid sequence encoding the constant region(s). In yet another embodiment, the term "acceptor" refers to the antibody amino acid providing or nucleic acid sequence encoding one or more of the framework regions and the constant region(s). In a specific embodiment, the term "acceptor" refers to a human antibody amino acid or nucleic acid sequence that provides or encodes at least 80%, in an embodiment, at least 85%, at least 90%, at least 95%, at least 98%, or 100% of the amino acid sequences of one or more of the framework regions. In accordance with this embodiment, an acceptor may contain at least 1, at least 2, at least 3, least 4, at least 5, or at least 10 amino acid residues that does (do) not occur at one or more specific positions of a human antibody. An acceptor framework region and/or acceptor constant region(s) may be, e.g., derived or obtained from a germline antibody gene, a mature antibody gene, a functional antibody (e.g., antibodies well known in the art, antibodies in development, or antibodies commercially available).

Human heavy chain and light chain acceptor sequences are known in the art. In one embodiment, human heavy chain and light chain acceptor sequences from V-base (hvbase.mrc-cpe.cam.ac.uk/) or from IMGT®, the international ImMunoGeneTics information System® (himgt.cines.fr/textes/IMGTrepertoire/LocusGenes/) are provided. The terms "germline antibody gene" or "gene fragment" refers to an immunoglobulin sequence encoded by non-lymphoid cells that have not undergone the maturation process that leads to genetic rearrangement and mutation for expression of a particular immunoglobulin. (See, e.g., Shapiro et al. (2002) Crit. Rev. Immunol. 22(3): 183-200; Marchalonis et al. (2001) Adv. Exp. Med. Biol. 484:13-30). One of the advantages provided by various embodiments stems from the recognition that germline antibody genes are more likely than mature antibody genes to conserve essential amino acid sequence structures characteristic of individuals in the species, hence less likely to be recognized as from a foreign source when used therapeutically in that species.

The terms "key" residues refer to certain residues within the variable region that have more impact on the binding specificity and/or affinity of an antibody, in particular a humanized antibody. A key residue includes, but is not limited to, one or more of the following: a residue that is adjacent to a CDR, a potential glycosylation site (can be either N- or O-glycosylation site), a rare residue, a residue capable of interacting with the antigen, a residue capable of interacting with a CDR, a canonical residue, a contact residue between heavy chain variable region and light chain variable region, a residue within the Vernier zone, and a residue in the region that overlaps between the Chothia definition of a variable heavy chain CDR1 and the Kabat definition of the first heavy chain framework.

The terms "humanized antibody" refers to antibodies that comprise heavy and light chain variable region sequences from a non-human species (e.g., a mouse) but in which at least a portion of the VH and/or VL sequence has been altered to be more "human-like", i.e., more similar to human germline variable sequences. One type of humanized antibody is a CDR-grafted antibody, in which human CDR sequences are introduced into non-human VH and VL sequences to replace the corresponding nonhuman CDR sequences. Also "humanized antibody" is an antibody or a variant, derivative, analog or fragment thereof which immunospecifically binds to an antigen of interest and which comprises a framework (FR) region having substantially the amino acid sequence of a human antibody and a complementary determining region (CDR) having substantially the amino acid sequence of a non-human antibody. The term "substantially" in the context of a CDR refers to a CDR having an amino acid sequence at least 80%, at least 85%, at least 90%, at least 95%, at least 98% or at least 99% identical to the amino acid sequence of a non-human antibody CDR. A humanized antibody comprises substantially all of at least one, and typically two, variable domains (Fab, Fab', F(ab')2, FabC, Fv) in which all or substantially all of the CDR regions correspond to those of a non-human immunoglobulin (i.e., donor antibody) and all or substantially all of the framework regions are those of a human immunoglobulin consensus sequence. In an embodiment, a humanized antibody also comprises at least a portion of an immunoglobulin constant region (Fc), typically that of a human immunoglobulin. In some embodiments, a humanized antibody contains both the light chain as well as at least the variable domain of a heavy chain. The antibody also may include the CH1, hinge, CH2, CH3, and CH4 regions of the heavy chain. In some embodiments, a humanized antibody only contains a humanized light chain. In some embodiments, a humanized antibody only contains a humanized heavy chain. In specific embodiments, a humanized antibody only contains a humanized variable domain of a light chain and/or humanized heavy chain.

A humanized antibody may be from any class of immunoglobulins, including IgM, IgG, IgD, IgA or IgE, or any isotype including without limitation IgG1, IgG2, IgG3, or IgG4. The humanized antibody may comprise sequences from more than one class or isotype, and particular constant domains may be selected to optimize desired effector functions using techniques well known in the art.

The framework and CDR regions of a humanized antibody need not correspond precisely to the parental sequences, e.g., the donor antibody CDR or the consensus framework may be mutagenized by substitution, insertion and/or deletion of at least one amino acid residue so that the CDR or framework residue at that site does not correspond to either the donor antibody or the consensus framework. In an embodiment, such mutations, however, will not be extensive. Usually, at least 80%, at least 85%, more at least 90%, and at least 95% of the humanized antibody residues will correspond to those of the parental FR and CDR sequences. The term "consensus framework" refers to the framework region in the consensus immunoglobulin sequence. The term "consensus immunoglobulin sequence" refers to the sequence formed from the most frequently occurring amino acids (or nucleotides) in a family of related immunoglobulin sequences (see e.g., Winnaker, From Genes to Clones (Verlagsgesellschaft, Weinheim, Germany 1987)). In a family of immunoglobulins, each position in the consensus sequence is occupied by the amino acid occurring most frequently at that position in the family. If two amino acids occur equally frequently, either can be included in the consensus sequence.

With respect to constructing DVD-binding protein or other binding protein molecules, a "linker" is used to denote polypeptides comprising two or more amino acid residues joined by peptide bonds and are used to link one or more antigen binding portions. Such linker polypeptides are well known in the art (see, e.g., Holliger et al. (1993) Proc. Natl. Acad. Sci. USA, 90: 6444-6448; Poljak et al. (1994) Structure, 2: 1121-1123). Exemplary linkers include, but are not limited to, GGGGSG (SEQ ID NO:1695), GGSGG (SEQ ID NO:1696), GGGGSGGGGS (SEQ ID NO:1697), GGSGGGGSGS (SEQ ID NO:1698), GGSGGGGSGGGGS (SEQ ID NO:1699), GGGGSGGGGSGGGG (SEQ ID NO:1700), GGGGSGGGGSGGGGS (SEQ ID NO:1701), ASTKGP (SEQ ID NO:1702), ASTKGPSVFPLAP (SEQ ID NO:1703), TVAAP (SEQ ID NO:1704), TVAAPSVFIFPP (SEQ ID NO:1705), AKTTPKLEEGEFSEAR (SEQ ID NO:1706), AKTTPKLEEGEFSEARV (SEQ ID NO:1707), AKTTPKLGG (SEQ ID NO:1710), SAKTTPKLGG (SEQ ID NO:1709), SAKTTP (SEQ ID NO:1702), RADAAP (SEQ ID NO:1711), RADAAPTVS (SEQ ID NO:1712), RADAAAAGGPGS (SEQ ID NO:1713), RADAAAAGGGGSGGGGSGGGGSGGGGS (SEQ ID NO:1714), SAKTTPKLEEGEFSEARV (SEQ ID NO:1715), ADAAP (SEQ ID NO:1716), ADAAPTVSIFPP (SEQ ID NO:2050), QPKAAP (SEQ ID NO:2051), QPKAAPSVTLFPP (SEQ ID NO:2052), AKTTPP (SEQ ID NO:2053), AKTTPPSVTPLAP (SEQ ID NO:2054), AKTTAP (SEQ ID NO:2055), AKTTAPSVYPLAP (SEQ ID NO:2056), GENKVEYAPALMALS (SEQ ID NO:2057), GPAKELTPLKEAKVS (SEQ ID NO:2058), and GHEAAAVMQVQYPAS (SEQ ID NO:2059).

The term "Vernier" zone refers to a subset of framework residues that may adjust CDR structure and fine-tune the fit to antigen as described by Foote and Winter (1992) J. Mol. Biol. 224:487-499). Vernier zone residues form a layer underlying the CDRs and may impact on the structure of CDRs and the affinity of the antibody.

The term "neutralizing" refers to neutralization of the biological activity of an antigen (e.g., SOST) when a binding protein specifically binds the antigen. In an embodiment, a neutralizing binding protein described herein binds to hSOST resulting in the inhibition of a biological activity of hSOST. In an embodiment, the neutralizing binding protein binds hSOST and reduces a biologically activity of hSOST by at least about 20%, 40%, 60%, 80%, 85%, or more. Inhibition of a biological activity of hSOST by a neutralizing binding protein can be assessed by measuring one or more indicators of hSOST biological activity well known in the art.

The term "activity" includes activities such as the binding specificity/affinity of an antibody for an antigen, for example, an anti-hSOST antibody that binds to an SOST antigen and/or the neutralizing potency of an antibody, for example, an anti-hSOST antibody whose binding to hSOST inhibits the biological activity of hSOST.

The term "epitope" includes any polypeptide determinant capable of specific binding to an immunoglobulin or T-cell receptor. In certain embodiments, epitope determinants include chemically active surface groupings of molecules such as amino acids, sugar side chains, phosphoryl, or sulfonyl, and, in certain embodiments, may have specific three dimensional structural characteristics, and/or specific charge characteristics. An epitope is a region of an antigen that is bound by an antibody. In certain embodiments, an antibody is said to specifically bind an antigen when it preferentially recognizes its target antigen in a complex mixture of proteins and/or macromolecules. Antibodies are said to "bind to the same epitope" if the antibodies cross-compete (one prevents the binding or modulating effect of the other). In addition, structural definitions of epitopes (overlapping, similar, identical) are informative, but functional definitions are often more relevant as they encompass structural (binding) and functional (modulation, competition) parameters.

The term "surface plasmon resonance" refers to an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). For further descriptions, see Jönsson et al. (1993) Ann. Biol. Clin. 51:19-26; Jonsson et al. (1991) BioTechniques, 11:620-627; Johnsson et al. (1995) J. Mol. Recognit. 8:125-131; and Johanson et al. (1991) Anal. Biochem. 198:268-277.

The term "$K_{on}$" (also "Kon", "kon") is intended to refer to the on rate constant for association of a binding protein (e.g., an antibody) to an antigen to form an association complex, e.g., antibody/antigen complex, as is known in the art. The "Kon" also is known by the terms "association rate constant", or "$k_a$", as used interchangeably herein. This value indicates the binding rate of an antibody to its target antigen or the rate of complex formation between an antibody and antigen as is shown by the equation below:

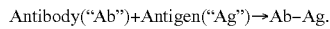

Antibody("Ab")+Antigen("Ag")→Ab–Ag.

The term "$K_{off}$" (also "Koff", "koff") is intended to refer to the off rate constant for dissociation, of a binding protein (e.g., an antibody) from an association complex (e.g., an antibody/antigen complex) as is known in the art. The "koff" also is known by the terms "dissociaciation rate constant", or "$k_d$", as used interchangeably herein. This value indicates the dissociation rate of an antibody from its target antigen or separation of Ab-Ag complex over time into free antibody and antigen as shown by the equation below:

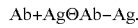

Ab+Ag⊖Ab–Ag.

The term "$K_D$" (also "$K_d$") is intended to refer to the "equilibrium dissociation constant", and refers to the value obtained in a titration measurement at equilibrium, or by dividing the dissociation rate constant (Koff) by the association rate constant (Kon). The association rate constant (Kon), the dissociation rate constant (Koff), and the equilibrium dissociation constant (K are used to represent the binding affinity of an antibody to an antigen. Methods for determining association and dissociation rate constants are well known in the art. Using fluorescence-based techniques offers high sensitivity and the ability to examine samples in physiological buffers at equilibrium. Other experimental approaches and instruments such as a BIAcore® (biomolecular interaction analysis) assay can be used (e.g., instrument available from BIAcore International AB, a GE Healthcare company, Uppsala, Sweden). Additionally, a KinExA® (Kinetic Exclusion Assay) assay, available from Sapidyne Instruments (Boise, Id.) can also be used.

The terms "label" and "detectable label" mean a moiety attached to a specific binding partner, such as an antibody or an analyte, e.g., to render the reaction between members of a specific binding pair, such as an antibody and an analyte, detectable. The specific binding partner, e.g., antibody or analyte, so labeled is referred to as "detectably labeled". Thus, the term "labeled binding protein" refers to a protein with a label incorporated that provides for the identification of the binding protein. In an embodiment, the label is a detectable marker that can produce a signal that is detectable by visual or instrumental means, e.g., incorporation of a radiolabeled amino acid or attachment to a polypeptide of biotinyl moieties that can be detected by marked avidin or streptavidin (e.g., streptavidin containing a fluorescent marker or enzymatic activity that can be detected by optical or colorimetric methods). Examples of labels for polypeptides include, but are not limited to, the following: radioisotopes or radionuclides (e.g., $^{3}H$, $^{14}C$, $^{35}S$, $^{90}Y$, $^{99}Tc$, $^{111}In$, $^{125}I$, $^{131}I$, $^{177}Lu$, $^{166}Ho$, or $^{153}Sm$), chromogens, fluorescent labels (e.g., FITC, rhodamine, lanthanide phosphors), enzymatic labels (e.g., horseradish peroxidase, luciferase, alkaline phosphatase), chemiluminescent markers, biotinyl groups, predetermined polypeptide epitopes recognized by a secondary reporter (e.g., leucine zipper pair sequences, binding sites for secondary antibodies, metal binding domains, epitope tags), and magnetic agents (e.g., gadolinium chelates). Representative examples of labels commonly employed for immunoassays include moieties that produce light, e.g., acridinium compounds, and moieties that produce fluorescence, e.g., fluorescein. Other labels are described herein. In this regard, the moiety itself may not be detectably labeled but may become detectable upon reaction with yet another moiety. Use of the term "detectably labeled" is intended to encompass the latter type of detectable labeling.

The term "SOST binding protein conjugate" or "sclerostin binding protein conjugate" refers to a sclerostin binding protein described herein chemically linked to a second chemical moiety, such as a therapeutic or cytotoxic agent. The term "agent" is used herein to denote a chemical compound, a mixture of chemical compounds, a biological macromolecule, or an extract made from biological materials. In an embodiment, the therapeutic or cytotoxic agents include, but are not limited to, pertussis toxin, taxol, cytochalasin B, gramicidin D, ethidium bromide, emetine, mitomycin, etoposide, tenoposide, vincristine, vinblastine, colchicine, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. When employed in the context of an immunoassay, a sclerostin binding protein conjugate may be a detectably labeled antibody, which is used as the detection antibody.

The terms "crystal" and "crystallized" refer to a binding protein (e.g., an antibody), or antigen binding portion thereof, that exists in the form of a crystal. Crystals are one form of the solid state of matter that is distinct from other forms such as the amorphous solid state or the liquid crystalline state. Crystals are composed of regular, repeating, three-dimensional arrays of atoms, ions, molecules (e.g., proteins such as antibodies), or molecular assemblies (e.g., antigen/antibody complexes). These three-dimensional arrays are arranged according to specific mathematical relationships that are well-understood in the field. The fundamental unit, or building block, that is repeated in a crystal is called the asymmetric unit. Repetition of the asymmetric unit in an arrangement that conforms to a given, well-defined crystallographic symmetry provides the "unit cell" of the crystal. Repetition of the unit cell by regular translations in all three dimensions provides the crystal. See Giegé et al., Chapter 1, In Crystallization of Nucleic Acids and Proteins, a Practical Approach, 2nd ed., (Ducruix and Giegé, eds.) (Oxford University Press, New York, 1999) pp. 1-16.

The term "polynucleotide" means a polymeric form of two or more nucleotides, either ribonucleotides or deoxynucleotides or a modified form of either type of nucleotide. The term includes single and double stranded forms of DNA.

The term "isolated polynucleotide" shall mean a polynucleotide (e.g., of genomic, cDNA, or synthetic origin, or some combination thereof) that, by virtue of its origin, the "isolated polynucleotide" is not associated with all or a portion of a polynucleotide with which the "isolated polynucleotide" is found in nature; is operably linked to a polynucleotide that it is not linked to in nature; or does not occur in nature as part of a larger sequence.

The term "vector" is intended to refer to a nucleic acid molecule capable of transporting another nucleic acid to which it has been linked One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, other forms of expression vectors, such as viral vectors (e.g., replication defective retroviruses, adenoviruses and adeno-associated viruses), which serve equivalent functions are provided.

The term "operably linked" refers to a juxtaposition wherein the components described are in a relationship permitting them to function in their intended manner A control sequence "operably linked" to a coding sequence is ligated in such a way that expression of the coding sequence is achieved under conditions compatible with the control sequences. "Operably linked" sequences include both expression control sequences that are contiguous with the gene of interest and expression control sequences that act in trans or at a distance to control the gene of interest. The term "expression control sequence" refers to polynucleotide sequences that are necessary to effect the expression and processing of coding sequences to which they are ligated. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (i.e., Kozak consensus sequence); sequences that enhance protein stability; and when desired, sequences that enhance protein secretion. The nature of such control sequences differs depending upon the host organism; in prokaryotes, such control sequences generally include promoter, ribosomal binding site, and transcription termination sequence; in eukaryotes, generally, such control sequences include promoters and transcription termination sequence. The term "control sequences" is intended to include components whose presence is essential for expression and processing, and can also include additional components whose presence is advantageous, for example, leader sequences and fusion partner sequences.

"Transformation", as defined herein, refers to any process by which exogenous DNA enters a host cell. Transformation may occur under natural or artificial conditions using various methods well known in the art. Transformation may rely on any known method for the insertion of foreign nucleic acid sequences into a prokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time.

The term "recombinant host cell" (or simply "host cell"), is intended to refer to a cell into which exogenous DNA has been introduced. In an embodiment, the host cell comprises two or more (e.g., multiple) nucleic acids encoding antibodies, such as the host cells described in U.S. Pat. No. 7,262,028, for example. Such terms are intended to refer not only to the particular subject cell, but also to the progeny of such a cell. Because certain modifications may occur in succeeding generations due to either mutation or environmental influences, such progeny may not, in fact, be identical to the parent cell, but are still included within the scope of the term "host cell". In an embodiment, host cells include prokaryotic and eukaryotic cells from any of the Kingdoms of life. In another embodiment, eukaryotic cells include protist, fungal, plant or animal cells. In another embodiment, host cells include but are not limited to the prokaryotic cell line *Escherichia coli*; mammalian cell lines CHO, HEK 293, COS, NS0, SP2 and PER.C6; the insect cell line Sf9; and the fungal cell *Saccharomyces cerevisiae*.

Standard techniques may be used for recombinant DNA, oligonucleotide synthesis, and tissue culture and transformation (e.g., electroporation, lipofection). Enzymatic reactions and purification techniques may be performed according to manufacturer's specifications or as commonly accomplished in the art or as described herein. The foregoing techniques and procedures may be generally performed according to conventional methods well known in the art and as described in various general and more specific references that are cited and discussed throughout the present specification. See e.g., Sambrook et al., Molecular Cloning: A Laboratory Manual, 2nd ed. (Cold Spring Harbor Laboratory Press, Cold Spring Harbor, N.Y., 1989).

"Transgenic organism", as known in the art, refers to an organism having cells that contain a transgene, wherein the transgene introduced into the organism (or an ancestor of the organism) expresses a polypeptide not naturally expressed in the organism. A "transgene" is a DNA construct, which is stably and operably integrated into the genome of a cell from which a transgenic organism develops, directing the expression of an encoded gene product in one or more cell types or tissues of the transgenic organism.

The terms "regulate" and "modulate" are used interchangeably, and refers to a change or an alteration in the activity of a molecule of interest (e.g., the biological activity of hSOST). Modulation may be an increase or a decrease in the magnitude of a certain activity or function of the molecule of interest. Exemplary activities and functions of a molecule include, but are not limited to, binding characteristics, enzymatic activity, cell receptor activation, and signal transduction.

Correspondingly, the term "modulator" is a compound capable of changing or altering an activity or function of a molecule of interest (e.g., the biological activity of hSOST). For example, a modulator may cause an increase or decrease in the magnitude of a certain activity or function of a molecule compared to the magnitude of the activity or function observed in the absence of the modulator. In certain embodiments, a modulator is an inhibitor, which decreases the magnitude of at least one activity or function of a molecule. Exemplary inhibitors include, but are not limited to, proteins, peptides, antibodies, peptibodies, carbohydrates or small organic molecules. Peptibodies are described, e.g., in PCT Publication No. WO01/83525.

The term "agonist" refers to a modulator that, when contacted with a molecule of interest, causes an increase in the magnitude of a certain activity or function of the molecule compared to the magnitude of the activity or function observed in the absence of the agonist. Particular agonists of interest may include, but are not limited to, sclerostin polypeptides, nucleic acids, carbohydrates, or any other molecule that binds to human sclerostin (hSOST).

The terms "antagonist" and "inhibitor" refer to a modulator that, when contacted with a molecule of interest causes a decrease in the magnitude of a certain activity or function of the molecule compared to the magnitude of the activity or function observed in the absence of the antagonist. Particular antagonists of interest include those that block or modulate the biological or immunological activity of human sclerostin. Antagonists and inhibitors of human sclerostin may include, but are not limited to, proteins, nucleic acids, carbohydrates, or any other molecules, which bind to human sclerostin.

The term "effective amount" refers to the amount of a therapy that is sufficient to reduce or ameliorate the severity and/or duration of a disorder or one or more symptoms thereof; prevent the advancement of a disorder; cause regression of a disorder; prevent the recurrence, development, onset, or progression of one or more symptoms associated with a disorder; detect a disorder; or enhance or improve the prophylactic or therapeutic effect(s) of another therapy (e.g., prophylactic or therapeutic agent).

"Patient" and "subject" may be used interchangeably herein to refer to an animal, such as a mammal, including a primate (for example, a human, a monkey, and a chimpanzee), a non-primate (for example, a cow, a pig, a camel, a llama, a horse, a goat, a rabbit, a sheep, a hamster, a guinea pig, a cat, a dog, a rat, a mouse, a whale), a bird (e.g., a duck or a goose), and a shark. In an embodiment, a patient or subject is a human, such as a human being treated or assessed for a disease, disorder or condition, a human at risk for a disease, disorder or condition, a human having a disease, disorder or condition, and/or human being treated for a disease, disorder or condition.

The term "sample" is used in its broadest sense. A "biological sample" includes, but is not limited to, any quantity of a substance from a living thing or formerly living thing. Such living things include, but are not limited to, humans, non-human primates, mice, rats, monkeys, dogs, rabbits and other animals. Such substances include, but are not limited to, blood (e.g., whole blood), plasma, serum, urine, amniotic fluid, synovial fluid, endothelial cells, leukocytes, monocytes, other cells, organs, tissues, bone marrow, lymph nodes and spleen.

"Component", "components," and "at least one component," refer generally to a capture antibody, a detection or conjugate antibody, a control, a calibrator, a series of calibrators, a sensitivity panel, a container, a buffer, a diluent, a salt, an enzyme, a co-factor for an enzyme, a detection reagent, a pretreatment reagent/solution, a substrate (e.g., as a solution), a stop solution, and the like that can be included in a kit for assay of a test sample, such as a patient urine, serum or plasma sample, in accordance with the methods described herein and other methods known in the art. Thus, in the context of the present disclosure, "at least one component," "component," and "components" can include a polypeptide or other analyte as above, such as a composition comprising an analyte such as polypeptide, which is optionally immobilized on a solid support, such as by binding to an anti-analyte (e.g., anti-polypeptide) antibody. Some components can be in solution or lyophilized for reconstitution for use in an assay.

"Control" refers to a composition known to not analyte ("negative control") or to contain analyte ("positive control"). A positive control can comprise a known concentration of analyte. "Control," "positive control," and "calibrator" may be used interchangeably herein to refer to a composition comprising a known concentration of analyte. A "positive control" can be used to establish assay performance characteristics and is a useful indicator of the integrity of reagents (e.g., analytes).

"Predetermined cutoff" and "predetermined level" refer generally to an assay cutoff value that is used to assess diagnostic/prognostic/therapeutic efficacy results by comparing the assay results against the predetermined cutoff/level, where the predetermined cutoff/level already has been linked or associated with various clinical parameters (e.g., severity of disease, progression/nonprogression/improvement, etc.). While the present disclosure may provide exemplary predetermined levels, it is well-known that cutoff values may vary depending on the nature of the immunoassay (e.g., antibodies employed, etc.). It further is well within the ordinary skill of one in the art to adapt the disclosure herein for other immunoassays to obtain immunoassay-specific cutoff values for those other immunoassays based on this disclosure. Whereas the precise value of the predetermined cutoff/level may vary between assays, correlations as described herein (if any) should be generally applicable.

"Pretreatment reagent," e.g., lysis, precipitation and/or solubilization reagent, as used in a diagnostic assay as described herein is one that lyses any cells and/or solubilizes any analyte that is/are present in a test sample. Pretreatment is not necessary for all samples, as described further herein. Among other things, solubilizing the analyte (e.g., polypeptide of interest) may entail release of the analyte from any endogenous binding proteins present in the sample. A pretreatment reagent may be homogeneous (not requiring a separation step) or heterogeneous (requiring a separation step). With use of a heterogeneous pretreatment reagent there is removal of any precipitated analyte binding proteins from the test sample prior to proceeding to the next step of the assay.

"Quality control reagents" in the context of immunoassays and kits described herein, include, but are not limited to, calibrators, controls, and sensitivity panels. A "calibrator" or "standard" typically is used (e.g., one or more, such as a plurality) in order to establish calibration (standard) curves for interpolation of the concentration of an analyte, such as an antibody or an analyte. Alternatively, a single calibrator, which is near a predetermined positive/negative cutoff, can be used. Multiple calibrators (i.e., more than one calibrator or a varying amount of calibrator(s)) can be used in conjunction so as to comprise a "sensitivity panel."

"Risk" refers to the possibility or probability of a particular event occurring either presently or at some point in the future. "Risk stratification" refers to an array of known clinical risk factors that allows physicians to classify patients into a low, moderate, high or highest risk of developing a particular disease, disorder or condition.

"Specific" and "specificity" in the context of an interaction between members of a specific binding pair (e.g., an antigen (or fragment thereof) and an antibody (or antigenically reactive fragment thereof)) refer to the selective reactivity of the interaction. The phrase "specifically binds to" and analogous phrases refer to the ability of antibodies (or antigenically reactive fragments thereof) to bind specifically to analyte (or a fragment thereof) and not bind specifically to other entities.

"Specific binding partner" is a member of a specific binding pair. A specific binding pair comprises two different molecules, which specifically bind to each other through chemical or physical means. Therefore, in addition to antigen and antibody specific binding pairs of common immunoassays, other specific binding pairs can include biotin and avidin (or streptavidin), carbohydrates and lectins, complementary nucleotide sequences, effector and receptor molecules, cofactors and enzymes, enzyme inhibitors and enzymes, and the like. Furthermore, specific binding pairs can include members that are analogs of the original specific binding members, for example, an analyte-analog. Immunoreactive specific binding members include antigens, antigen fragments, and antibodies, including monoclonal and polyclonal antibodies as well as complexes, fragments, and variants (including fragments of variants) thereof, whether isolated or recombinantly produced.

The term "variant" means a polypeptide that differs from a given polypeptide (e.g., sclerostin, BNP, NGAL, or HIV polypeptide, or anti-polypeptide antibody) in amino acid sequence by the addition (e.g., insertion), deletion, or conservative substitution of amino acids, but that retains the biological activity of the given polypeptide (e.g., a variant sclerostin can compete with anti-sclerostin antibody for binding to sclerostin). A conservative substitution of an amino acid, i.e., replacing an amino acid with a different amino acid of similar properties (e.g., hydrophilicity and degree and distribution of charged regions) is recognized in the art as typically involving a minor change. These minor changes can be identified, in part, by considering the hydropathic index of amino acids, as understood in the art (see, e.g., Kyte et al. (1982) J. Mol. Biol. 157:105-132). The hydropathic index of an amino acid is based on a consideration of its hydrophobicity and charge. It is known in the art that amino acids of similar hydropathic indexes can be substituted and still retain protein function. In one aspect, amino acids having hydropathic indexes of ±2 are substituted. The hydrophilicity of amino acids also can be used to reveal substitutions that would result in proteins retaining biological function. A consideration of the hydrophilicity of amino acids in the context of a peptide permits calculation of the greatest local average hydrophilicity of that peptide, a useful measure that has been reported to correlate well with antigenicity and immunogenicity (see, e.g., U.S. Pat. No. 4,554,101). Substitution of amino acids having similar hydrophilicity values can result in peptides retaining biological activity, for example immunogenicity, as is understood in the art. In one aspect, substitutions are performed with amino acids having hydrophilicity values within ±2 of each other. Both the hydrophobicity index and the hydrophilicity value of amino acids are influenced by the particular side chain of that amino acid. Consistent with that observation, amino acid substitutions that are compatible with biological function are understood to depend on the relative similarity of the amino acids, and particularly the side chains of those amino acids, as revealed by the hydrophobicity, hydrophilicity, charge, size, and other properties. "Variant" also can be used to describe a polypeptide or fragment thereof that has been differentially processed, such as by proteolysis, phosphorylation, or other post-translational modification, yet retains its biological activity or antigen reactivity, e.g., the ability to bind to sclerostin. Use of "variant" herein is intended to encompass fragments of a variant unless otherwise contradicted by context.

I. Antibodies that Bind Human SOST.

One aspect provides isolated murine monoclonal antibodies, or antigen-binding portions thereof, that bind to sclerostin with high affinity, a slow off rate and high neutralizing capacity. A second aspect provides chimeric antibodies that bind sclerostin. A third aspect provides CDR grafted antibodies, or antigen-binding portions thereof, that bind sclerostin. A fourth aspect provides humanized antibodies, or antigen-binding portions thereof, that bind sclerostin. A fifth aspect provides dual variable domain binding proteins (DVD-binding proteins) that bind sclerostin and one other target. In an embodiment, the antibodies, or portions thereof, are isolated antibodies. In an embodiment, the antibodies neutralizing human anti-sclerostin are provided.

I.A. Method of Making Anti Sclerostin Antibodies

Anti sclerostin antibodies made by any of a number of techniques known in the art are provided.

I.A.1. Anti Sclerostin Monoclonal Antibodies Using Hybridoma Technology

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., Antibodies: A Laboratory Manual, 2nd ed. (Cold Spring Harbor Laboratory Press, 1988); Hammerling, et al., in: Monoclonal Antibodies and T-Cell Hybridomas 563-681 (Elsevier, N.Y., 1981). The term "monoclonal antibody" is not limited to antibodies produced through hybridoma technology. The term "monoclonal antibody" refers to an antibody that is derived from a single clone, including any eukaryotic, prokaryotic, or phage clone, and not the method by which it is produced.

Methods for producing and screening for specific anti-sclerostin antibodies using hybridoma technology are routine and well known in the art. One embodiment provides methods of generating monoclonal antibodies as well as antibodies produced by the method comprising culturing a hybridoma cell secreting an antibody wherein, in an embodiment, the hybridoma is generated by fusing splenocytes isolated from a mouse immunized with an antigen with myeloma cells and then screening the hybridomas resulting from the fusion for hybridoma clones that secrete an antibody able to bind a polypeptide. Briefly, mice can be immunized with an sclerostin antigen. In an embodiment, the sclerostin antigen is administered with an adjuvant to stimulate the immune response. Such adjuvants include complete or incomplete Freund's adjuvant, RIBI (muramyl dipeptides) or ISCOM (immunostimulating complexes). Such adjuvants may protect the polypeptide from rapid dispersal by sequestering it in a local deposit, or they may contain substances that stimulate the host to secrete factors that are chemotactic for macrophages and other components of the immune system. In an embodiment, if a polypeptide is being administered, the immunization schedule will involve two or more administrations of the polypeptide, spread out over several weeks.

After immunization of an animal with an sclerostin antigen, antibodies and/or antibody-producing cells may be obtained from the animal. An anti-sclerostin antibody-containing serum is obtained from the animal by bleeding or sacrificing the animal. The serum may be used as it is obtained from the animal, an immunoglobulin fraction may be obtained from the serum, or the anti-sclerostin antibodies may be purified from the serum. Serum or immunoglobulins obtained in this manner are polyclonal, thus having a heterogeneous array of properties.

Once an immune response is detected, e.g., antibodies specific for the antigen SOST are detected in the mouse serum, the mouse spleen is harvested and splenocytes isolated. The splenocytes are then fused by well-known techniques to any suitable myeloma cells, for example cells from cell line SP20 available from the American Type Culture Collection (ATCC, Manassas, Va., US). Hybridomas are selected and cloned by limited dilution. The hybridoma clones are then assayed by methods known in the art for cells that secrete antibodies capable of binding SOST. Ascites fluid, which generally contains high levels of antibodies, can be generated by immunizing mice with positive hybridoma clones.

In another embodiment, antibody-producing immortalized hybridomas may be prepared from the immunized animal. After immunization, the animal is sacrificed and the splenic B cells are fused to immortalized myeloma cells as is well known in the art. See, e.g., Harlow and Lane, supra. In an embodiment, the myeloma cells do not secrete immunoglobulin polypeptides (a non-secretory cell line). After fusion and antibiotic selection, the hybridomas are screened using SOST, or a portion thereof, or a cell expressing SOST. In an embodiment, the initial screening is performed using an enzyme-linked immunoassay (ELISA) or a radioimmunoassay (RIA), in an embodiment, an ELISA. An example of ELISA screening is provided in PCT Publication No. WO 00/37504.

Anti-sclerostin antibody-producing hybridomas are selected, cloned, and further screened for desirable characteristics, including robust hybridoma growth, high antibody production and desirable antibody characteristics, as discussed further below. Hybridomas may be cultured and expanded in vivo in syngeneic animals, in animals that lack an immune system, e.g., nude mice, or in cell culture in vitro. Methods of selecting, cloning and expanding hybridomas are well known to those of ordinary skill in the art.

In an embodiment, the hybridomas are mouse hybridomas, as described above. In another embodiment, the hybridomas are produced in a non-human, non-mouse species such as rats, sheep, pigs, goats, cattle or horses. In another embodiment, the hybridomas are human hybridomas, in which a human non-secretory myeloma is fused with a human cell expressing an anti-sclerostin antibody.

Antibody fragments that recognize specific epitopes may be generated by known techniques. For example, Fab and F(ab')2 fragments produced by proteolytic cleavage of immunoglobulin molecules, using enzymes such as papain (to produce Fab fragments) or pepsin (to produce F(ab')2 fragments), are provided. F(ab')2 fragments contain the variable region, the light chain constant region and the CH1 domain of the heavy chain.

I.A.2. Anti-Sclerostin Monoclonal Antibodies Using SLAM

In another embodiment, recombinant antibodies generated from single, isolated lymphocytes using a procedure referred to in the art as the selected lymphocyte antibody method (SLAM) are provided, as described in U.S. Pat. No. 5,627,052; PCT Publication No. WO 92/02551; and Babcook et al. (1996) Proc. Natl. Acad. Sci. USA 93: 7843-7848. In this method, single cells secreting antibodies of interest, e.g., lymphocytes derived from any one of the immunized animals described in Section 1, are screened using an antigen-specific hemolytic plaque assay, wherein the antigen SOST, a subunit of SOST, or a fragment thereof, is coupled to sheep red blood cells using a linker, such as biotin, and used to identify single cells that secrete antibodies with specificity for SOST. Following identification of antibody-secreting cells of interest, heavy and light chain variable region (VH and VL) cDNAs are rescued from the cells by reverse transcriptase-PCR, and these variable regions can then be expressed, in the context of appropriate immunoglobulin constant regions (e.g., human constant regions), in mammalian host cells, such as COS or CHO cells. The host cells transfected with the amplified immunoglobulin sequences, derived from in vivo selected lymphocytes, can then undergo further analysis and selection in vitro, for example, by panning the transfected cells to isolate cells expressing antibodies to SOST. The amplified immunoglobulin sequences further can be manipulated in vitro, such as by in vitro affinity maturation methods such as those described in PCT Publication Nos. WO 97/29131 and WO 00/56772.

I.A.3. Anti-Sclerostin Monoclonal Antibodies Using Transgenic Animals

In another embodiment, antibodies produced by immunizing a non-human animal comprising some, or all, of the human immunoglobulin locus with an SOST antigen are provided. In an embodiment, the non-human animal is a XENOMOUSE transgenic mouse, an engineered mouse strain that comprises large fragments of the human immunoglobulin loci and is deficient in mouse antibody production. See, e.g., Green et al. (1994) Nature Genet. 7:13-21 and U.S. Pat. Nos. 5,916,771; 5,939,598; 5,985,615; 5,998,209; 6,075,181; 6,091,001; 6,114,598 and 6,130,364. See also PCT Publication Nos. WO 91/10741; WO 94/02602; WO 96/34096 and WO 96/33735; WO 98/16654; WO 98/24893; WO 98/50433; WO 99/45031; WO 99/53049; WO 00/09560; and WO 00/037504. The XENOMOUSE® transgenic mouseproduces an adult-like human repertoire of fully human antibodies, and generates antigen-specific human Mabs. The XENOMOUSE® transgenic mouse contains approximately 80% of the human antibody repertoire through introduction of megabase sized, germline configuration YAC fragments of the human heavy chain loci and x light chain loci. See, Mendez et al., *Nature Genetics*, 15:146-156 (1997); and Green and Jakobovits, *J. Exp. Med.*, 188: 483-495 (1998).

I.A.4. Anti-Sclerostin Monoclonal Antibodies Using Recombinant Antibody Libraries In vitro methods to make antibodies are provided, wherein an antibody library is screened to identify an antibody having the desired binding specificity. Methods for such screening of recombinant antibody libraries are well known in the art and include methods described in, for example, Ladner et al., U.S. Pat. No. 5,223,409; Kang et al., PCT Publication No. WO 92/18619; Dower et al., PCT Publication No. WO 91/17271; Winter et al., PCT Publication No. WO 92/20791; Markland et al., PCT Publication No. WO 92/15679; Breitling et al., PCT Publication No. WO 93/01288; McCafferty et al., PCT Publication No. WO 92/01047; Garrard et al., PCT Publication No. WO 92/09690; Fuchs et al., *Bio/Technology*, 9: 1369-

1372 (1991); Hay et al., *Hum. Antibod. Hybridomas*, 3: 81-85 (1992); Huse et al., *Science*, 246: 1275-1281 (1989); McCafferty et al., *Nature*, 348: 552-554 (1990); Griffiths et al., *EMBO J.*, 12: 725-734 (1993); Hawkins et al., *J. Mol. Biol.*, 226: 889-896 (1992); Clackson et al., *Nature*, 352: 624-628 (1991); Gram et al., *Proc. Natl. Acad. Sci. USA*, 89: 3576-3580 (1992); Garrard et al., *Bio/Technology*, 9: 1373-1377 (1991); Hoogenboom et al., *Nucl. Acid Res.*, 19: 4133-4137 (1991); and Barbas et al., *Proc. Natl. Acad. Sci. USA*, 88: 7978-7982 (1991); US patent application publication No. 2003/0186374; and PCT Publication No. WO 97/29131.

The recombinant antibody library may be from a subject immunized with sclerostin, or a portion of sclerostin. Alternatively, the recombinant antibody library may be from a naïve subject, i.e., one who has not been immunized with sclerostin, such as a human antibody library from a human subject who has not been immunized with human sclerostin. Antibodies of the invention are selected by screening the recombinant antibody library with the peptide comprising human sclerostin to thereby select those antibodies that recognize sclerostin. Methods for conducting such screening and selection are well known in the art, such as described in the references in the preceding paragraph. To select antibodies having particular binding affinities for human sclerostin, such as those that dissociate from human sclerostin with a particular $K_{off}$ rate constant, the art-known method of surface plasmon resonance can be used to select antibodies having the desired $K_{off}$ rate constant. To select antibodies having a particular neutralizing activity for human sclerostin, such as those with a particular an $IC_{50}$, standard methods known in the art for assessing the inhibition of human sclerostin activity may be used.

In one aspect, an isolated antibody, or an antigen-binding portion thereof, that binds human sclerostin is provided. In an embodiment, the antibody is a neutralizing antibody. In various embodiments, the antibody is a recombinant antibody or a monoclonal antibody.

For example, the antibodies that are provided can also be generated using various phage display methods known in the art. In phage display methods, functional antibody domains are displayed on the surface of phage particles which carry the polynucleotide sequences encoding them. In a particular, such phage can be utilized to display antigen-binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv, or disulfide stabilized Fv antibody domains recombinantly fused to either the phage gene III or gene VIII protein. Phage display methods that can be used to make the antibodies invention are provided and include those disclosed in Brinkmann et al., *J. Immunol. Methods*, 182: 41-50 (1995); Ames et al., *J. Immunol. Methods*, 184: 177-186 (1995); Kettleborough et al., *Eur. J. Immunol.*, 24: 952-958 (1994); Persic et al., *Gene*, 187: 9-18 (1997); Burton et al., *Advances in Immunology*, 57:191-280 (1994); PCT Publications Nos. WO 90/02809; WO 91/10737; WO 92/01047 (PCT/GB91/01134); WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780, 225; 5,658,727; 5,733,743 and 5,969,108.

As described in the above references, after phage selection, the antibody coding regions from the phage can be isolated and used to generate whole antibodies including human antibodies or any other desired antigen binding fragment, and expressed in any desired host, including mammalian cells, insect cells, plant cells, yeast, and bacteria, e.g., as described in detail below. For example, techniques to recombinantly produce Fab, Fab' and F(ab')2 fragments can also be employed using methods known in the art such as those disclosed in PCT publication WO 92/22324; Mullinax et al., *BioTechniques*, 12(6): 864-869 (1992); and Sawai et al., *Am. J. Reprod. Immunol.*, 34: 26-34 (1995); and Better et al., *Science*, 240: 1041-1043 (1988). Examples of techniques which can be used to produce single-chain Fvs and antibodies include those described in U.S. Pat. Nos. 4,946,778 and 5,258,498; Huston et al., *Methods in Enzymology*, 203: 46-88 (1991); Shu et al., *Proc. Natl. Acad. Sci. USA*, 90: 7995-7999 (1993); and Skerra et al., *Science*, 240: 1038-1041 (1988).

Alternative to screening of recombinant antibody libraries by phage display, other methodologies known in the art for screening large combinatorial libraries are provided and can be applied to the identification of dual specificity antibodies. One type of alternative expression system is one in which the recombinant antibody library is expressed as RNA-protein fusions, as described in PCT Publication No. WO 98/31700 by Szostak and Roberts, and in Roberts, R. W. and Szostak, J. W. (1997) *Proc. Natl. Acad. Sci. USA*, 94: 12297-12302. In this system, a covalent fusion is created between an mRNA and the peptide or protein that it encodes by in vitro translation of synthetic mRNAs that carry puromycin, a peptidyl acceptor antibiotic, at their 3' end. Thus, a specific mRNA can be enriched from a complex mixture of mRNAs (e.g., a combinatorial library) based on the properties of the encoded peptide or protein, e.g., antibody, or portion thereof, such as binding of the antibody, or portion thereof, to the dual specificity antigen. Nucleic acid sequences encoding antibodies, or portions thereof, recovered from screening of such libraries can be expressed by recombinant means as described above (e.g., in mammalian host cells) and, moreover, can be subjected to further affinity maturation by either additional rounds of screening of mRNA-peptide fusions in which mutations have been introduced into the originally selected sequence(s), or by other methods for affinity maturation in vitro of recombinant antibodies, as described above.

In another approach, antibodies generated using yeast display methods known in the art are provided. In yeast display methods, genetic methods are used to tether antibody domains to the yeast cell wall and display them on the surface of yeast. In particular, such yeast can be utilized to display antigen-binding domains expressed from a repertoire or combinatorial antibody library (e.g., human or murine). Examples of yeast display methods that can be used to make the antibodies are provided, and include those disclosed by Wittrup et al. in U.S. Pat. No. 6,699,658.

I.B. Production of Recombinant Sclerostin Antibodies

Antibodies produced by any of a number of techniques known in the art are provided. For example, expression from host cells, wherein expression vector(s) encoding the heavy and light chains is (are) transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection, and the like. Although it is possible to express the antibodies that are provided in either prokaryotic or eukaryotic host cells, expression of antibodies in eukaryotic cells is preferable, and most preferable in mammalian host cells, because such eukaryotic cells (and in particular mammalian cells) are more likely than prokaryotic cells to assemble and secrete a properly folded and immunologically active antibody.

Exemplary mammalian host cells for expressing the recombinant antibodies that are provided include Chinese Hamster Ovary (CHO cells) (including dhfr-CHO cells, described in Urlaub and Chasin, (1980) *Proc. Natl. Acad. Sci. USA*, 77: 4216-4220, used with a DHFR selectable marker, e.g., as described in R. J. Kaufman and P. A. Sharp (1982) *Mol. Biol*,. 159: 601-621), NS0 myeloma cells, COS cells and SP2 cells. When recombinant expression vectors encoding antibody genes are introduced into mammalian host cells, the antibodies are produced by culturing the host cells for a period of time sufficient to allow for expression of the antibody in the host cells or, in an embodiment, secretion of the antibody into the culture medium in which the host cells are grown. Antibodies can be recovered from the culture medium using standard protein purification methods.

Host cells can also be used to produce functional antibody fragments, such as Fab fragments or scFv molecules. It will be understood that variations on the above procedure are within the scope of what is provided. For example, it may be desirable to transfect a host cell with DNA encoding functional fragments of either the light chain and/or the heavy chain of an antibody, as provided. Recombinant DNA technology may also be used to remove some, or all, of the DNA encoding either or both of the light and heavy chains that is not necessary for binding to the antigens of interest. The molecules expressed from such truncated DNA molecules are also encompassed by the antibodies, as provided. In addition, bifunctional antibodies are provided and may be produced in which one heavy and one light chain are an antibody and the other heavy and light chain are specific for an antigen other than the antigens of interest by crosslinking an antibody to a second antibody by standard chemical crosslinking methods.

In an exemplary system for recombinant expression of an antibody, or antigen-binding portion thereof, a recombinant expression vector encoding both the antibody heavy chain and the antibody light chain is introduced into dhfr-CHO cells by calcium phosphate-mediated transfection is provided. Within the recombinant expression vector, the antibody heavy and light chain genes are each operatively linked to CMV enhancer/AdMLP promoter regulatory elements to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells and recover the antibody from the culture medium. Still further, a method of synthesizing a recombinant antibody by culturing a host cell in a suitable culture medium until a recombinant antibody is synthesized is provided. The method can further comprise isolating the recombinant antibody from the culture medium.

I.B.1. Anti Human Sclerostin Antibodies

Tables herein provide a list of amino acid sequences of VH and VL regions of exemplary human anti-human sclerostin antibodies.

Table 6 provides a sclerostin binding protein comprising an antigen binding domain capable of binding human sclerostin, said antigen binding domain comprising at least one CDR comprising an amino acid sequence provided therein.

I.B.2. Anti Human Sclerostin Chimeric Antibodies

A chimeric antibody is a molecule in which different portions of the antibody are derived from different animal species, such as antibodies having a variable region derived from a murine monoclonal antibody and a human immunoglobulin constant region. Methods for producing chimeric antibodies are known in the art and discussed in detail in the Examples section. See e.g., Morrison, *Science*, 229: 1202-1207 (1985); Oi et al., *BioTechniques*, 4: 214-221 (1986); Gillies et al., *J. Immunol. Methods*, 125: 191-202 (1989); U.S. Pat. Nos. 5,807,715; 4,816,567; and 4,816,397. In addition, techniques developed for the production of "chimeric antibodies" (Morrison et al., *Proc. Natl. Acad. Sci. USA*, 81: 6851-6855 (1984); Neuberger et al., *Nature*, 312: 604-608 (1984); Takeda et al., *Nature*, 314: 452-454 (1985) by splicing genes from a mouse antibody molecule of appropriate antigen specificity together with genes from a human antibody molecule of appropriate biological activity can be used.

In one embodiment, chimeric antibodies produced by replacing the heavy chain constant region of the murine monoclonal anti human sclerostin antibodies described in section 1 with a human IgG1 constant region are provided.

I.B.3. Anti SOST CDR-Grafted Antibodies

CDR-grafted antibodies comprising heavy and light chain variable region sequences from a human antibody wherein one or more of the CDR regions of $V_H$ and/or $V_L$ are replaced with CDR sequences of the murine antibodies are provided. A framework sequence from any human antibody may serve as the template for CDR grafting. However, straight chain replacement onto such a framework often leads to some loss of binding affinity to the antigen. The more homologous a human antibody is to the original murine antibody, the less likely the possibility that combining the murine CDRs with the human framework will introduce distortions in the CDRs that could reduce affinity. Therefore, it is preferable that the human variable framework that is chosen to replace the murine variable framework apart from the CDRs have at least a 65% sequence identity with the murine antibody variable region framework. It is more preferable that the human and murine variable regions apart from the CDRs have at least 70% sequence identify. It is even more preferable that the human and murine variable regions apart from the CDRs have at least 75% sequence identity. It is most preferable that the human and murine variable regions apart from the CDRs have at least 80% sequence identity. Methods for producing chimeric antibodies are known in the art. (also see EP 0 239 400; PCT Publication No. WO 91/09967; U.S. Pat. Nos. 5,225,539; 5,530,101; and 5,585,089); veneering or resurfacing (see, e.g., EP 0 592 106; EP 0 519 596; Padlan, *Molecular Immunology*, 28(4/5): 489-498 (1991); Studnicka et al., *Protein Engineering*, 7(6): 805-814 (1994); Roguska et al., *Proc. Natl. Acad. Sci. USA*, 91: 969-973 (1994)); and chain shuffling (see, e.g., U.S. Pat. No. 5,565,352).

I.B.4. Anti-Human Sclerostin Humanized Antibodies

Humanized antibodies are antibody molecules derived from non-human species antibody that binds the desired antigen having one or more complementarity determining regions (CDRs) from the non-human species antibody and framework regions from a human immunoglobulin molecule. Known human Ig sequences are disclosed, e.g., at worldwide web sites: www.ncbi.nlm.nih.gov/entrez-/query.fcgi; www.atcc.org/phage/hdb.html; www.sciquest.com/; www.abcam.com/; www.antibodyresource.com/onlinecomp.html; www.public.iastate.edu/.about.pedro/research_tools.html; www.mgen.uni-heidelberg.de/SD/IT/IT.html; www.whfreeman.com/immunology/CH-05/kuby05.htm; www.library.thinkquestorg/12429/Immune/Antibody.html;

www.hhmi.org/grants/lectures/1996/vlab/; www.path.cam.ac.uk/.about.mrc7/m-ikeimages.html; www.antibodyresource.com/; mcb.harvard.edu/BioLinks/Immuno-logy.html.www.immunologylink.com/; pathbox.wustl.edu/.about.hcenter/index.-html; www.biotech.ufl.edu/.about.hcl/; www.pebio.com/pa/340913/340913.htm1-; www.nal.usda.gov/awic/pubs/antibody/; www.m.ehime-u.acjp/.about.yasuhito-/Elisa.html; www.biodesign.com/table.asp; www.icnet.uk/axp/facs/davies/lin-ks.html; www.biotech.ufl.edu/.about.fccl/protocol.html; www.isac-net.org/sites_geo.html; aximtl.imt.uni-marburg.de/.about.rek/AEP-Start.html; baserv.uci.kundaabout.jraats/linksl.html; www.recab.unihd.de/immuno.bme.nwu.edu/; www.mrc-cpe.cam.ac.uk/imt-doc/pu-blic/INTRO.html; www.ibt.unam.mx/vir/V_mice.html; imgt.cnusc.fr:8104/; www.biochem.ucl.ac.uld.about.martin/abs/index.html; antibody.bath.ac.uk/; abgen.cvm.tamu.edu/lab/wwwabgen.html; www.unizh.ch/.about.honegger/AHOsem-inar/Slide01.html; www.cryst.bbk.ac.uk/.aboutubcg07s/; www.n-imr mrc.ac.uk/CC/ccaewg/ccaewg.htm; www.path.cam.ac.uk/.about.mrc7/h-umanisation/TAHHP.html; www.ibt.unam.mx/vir/structure/stat_aim.html; www.biosci.missouri.edu/smithgp/index.html; www.cryst.bioc.cam.ac.uk/.abo-ut.fmolina/Web-pages/Pept/spottech.html; www.jerini.de/fr roducts.htm; www.patents.ibm.com/ibm.html.Kabat et al., Sequences of Proteins of Immunological Interest, U.S. Dept. Health (1983). Such imported sequences can be used to reduce immunogenicity or reduce, enhance or modify binding, affinity, on-rate, off-rate, avidity, specificity, half-life, or any other suitable characteristic, as known in the art.

Framework (FR) residues in the human framework regions may be substituted with the corresponding residue from the CDR donor antibody to alter, in an embodiment, improve, antigen binding. These framework substitutions are identified by methods well known in the art, e.g., by modeling of the interactions of the CDR and framework residues to identify framework residues important for antigen binding and sequence comparison to identify unusual framework residues at particular positions. See, e.g., Queen et al., U.S. Pat. No. 5,585,089; Riechmann et al., Nature, 332: 323-327 (1988). Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the consensus and import sequences so that the desired antibody characteristic, such as increased affinity for the target antigen(s), is achieved. In general, the CDR residues are directly and most substantially involved in influencing antigen binding. Antibodies can be humanized using a variety of techniques known in the art, such as but not limited to those described in Jones et al., Nature, 321:522-525 (1986); Verhoeyen et al., Science, 239:1534-1536 (1988); Sims et al., J. Immunol., 151: 2296-2308 (1993); Chothia and Lesk, J. Mol. Biol., 196: 901-917 (1987), Carter et al., Proc. Natl. Acad. Sci. USA, 89: 4285-4289 (1992); Presta et al., J. Immunol., 151: 2623-2632 (1993); Padlan, Molecular Immunology, 28(4/5): 489-498 (1991); Studnicka et al., Protein Engineering, 7(6): 805-814 (1994); Roguska et al., Proc. Natl. Acad. Sci. USA, 91: 969-973 (1994); PCT Publication Nos. WO 91/09967; WO 90/14443; WO 90/14424; WO 90/14430; WO 99/06834 (PCT/U598/16280); WO 97/20032 (PCT/US96/18978); WO 92/11272 (PCT/US91/09630); WO 92/03461 (PCT/US91/05939); WO 94/18219 (PCT/US94/01234); WO 92/01047 (PCT/GB91/01134); and WO 93/06213 (PCT/GB92/01755); EP Patent Nos. EP 0 592 106; EP 0 519 596 and EP 0 239 400; U.S. Pat. Nos. 5,565,332; 5,723,323; 5,976,862; 5,824,514; 5,817,483; 5,814,476; 5,763,192; 5,723,323; 5,766,886; 5,714,352; 6,204,023; 6,180,370; 5,693,762; 5,530,101; 5,585,089; 5,225,539 and 4,816,567.

I.B.5. Anti-Sclerostin DVD-Binding Proteins

Also provided are dual variable domain binding proteins (DVD-binding proteins) that bind one or more epitopes of sclerostin. A DVD-binding protein may also bind an epitope of sclerostin and an epitope of a second target antigen other than an sclerostin polypeptide. An embodiment of such DVD-binding proteins comprises a heavy chain that comprises the structural formula VD1-(X1)n-VD2-C—(X2)n, wherein VD1 is a first heavy chain variable domain, VD2 is a second heavy chain variable domain, C is a heavy chain constant domain, X1 is a linker with the proviso that it is not CH1 X2 is an Fc region, and n is 0 or 1, and, in an embodiment, 1; and a light chain that comprises the structural formula VD1-(X1)n-VD2-C—(X2)n, wherein VD1 is a first light chain variable domain, VD2 is a second light chain variable domain, C is a light chain constant domain, X1 is a linker with the proviso that it is not CL, and X2 does not comprise an Fc region; and n is 0 or 1, and, in an embodiment, 1. Such a DVD-binding protein may comprise two such heavy chains and two such light chains, wherein each chain comprises variable domains linked in tandem without an intervening constant region between variable regions, wherein a heavy chain and a light chain associate to form two tandem antigen binding sites, and a pair of heavy and light chains may associate with another pair of heavy and light chains to form a tetrameric binding protein with four antigen binding sites. In another embodiment, a DVD-binding protein may comprise heavy and light chains that each comprise three variable domains, e.g., VD1, VD2, VD3, linked in tandem without an intervening constant region between variable domains, wherein a pair of heavy and light chains may associate to form three antigen binding sites, and wherein a pair of heavy and light chains may associate with another pair of heavy and light chains to form a tetrameric binding protein with six antigen binding sites.

Each variable domain (VD) in a DVD-binding protein may be obtained from one or more "parent" monoclonal antibodies that bind one or more desired antigens or epitopes, such as sclerostin and/or non-sclerostin antigens or epitopes (e.g., TNF-α).

III.A. Generation of Parent Monoclonal Antibodies

The variable domains of the DVD-binding protein can be obtained from parent antibodies, including monoclonal antibodies (mAb), capable of binding antigens of interest. These antibodies may be naturally occurring or may be generated by recombinant technology. It is understood that if an antibody that binds a desired target antigen or epitope is polyclonal then it is still necessary to obtain the variable domains of an antigen binding site of a single antibody from the polyclonal population, i.e., of a single monoclonal member of the polyclonal population, for use in generating a DVD-binding protein. Monoclonal antibodies may be generated by any of variety of methods known in the art, including those described herein (see, sections A.1.-A.4., above).

III.B. Criteria for Selecting Parent Monoclonal Antibodies

An embodiment pertaining to selecting parent antibodies with at least one or more properties desired in the DVD-binding protein is provided. In an embodiment, the desired property is one or more antibody parameters. In another embodiment, the antibody parameters are antigen specificity, affinity to antigen, potency, biological function, epitope recognition, stability, solubility, production efficiency, immunogenicity, pharmacokinetics, bioavailability, tissue cross reactivity, and orthologous antigen binding.

III.B.1. Affinity to Antigen

The desired affinity of a therapeutic mAb may depend upon the nature of the antigen, and the desired therapeutic endpoint. In an embodiment, monoclonal antibodies have higher affinities (Kd=0.01–0.50 pM) when blocking a cytokine-cytokine receptor interaction as such interaction are usually high affinity interactions (e.g., <pM-<nM ranges). In such instances, the mAb affinity for its target should be equal to or better than the affinity of the cytokine (ligand) for its receptor. On the other hand, mAb with lesser affinity (>nM range) could be therapeutically effective, e.g., in clearing circulating potentially pathogenic proteins e.g., monoclonal antibodies that bind to, sequester, and clear circulating species of a target antigen, such as A-β amyloid. In other instances, reducing the affinity of an existing high affinity mAb by site-directed mutagenesis or using a mAb with lower affinity for its target could be used to avoid potential side-effects, e.g., a high affinity mAb may sequester or neutralize all of its intended target, thereby completely depleting/eliminating the function(s) of the targeted protein. In this scenario, a low affinity mAb may sequester/neutralize a fraction of the target that may be responsible for the disease symptoms (the pathological or over-produced levels), thus allowing a fraction of the target to continue to perform its normal physiological function(s). Therefore, it may be possible to reduce the Kd to adjust dose and/or reduce side-effects. The affinity of the parental mAb might play a role in appropriately targeting cell surface molecules to achieve desired therapeutic out-come. For example, if a target is expressed on cancer cells with high density and on normal cells with low density, a lower affinity mAb will bind a greater number of targets on tumor cells than normal cells, resulting in tumor cell elimination via ADCC or CDC, and therefore might have therapeutically desirable effects. Thus, selecting a mAb with desired affinity may be relevant for both soluble and surface targets.

Signaling through a receptor upon interaction with its ligand may depend upon the affinity of the receptor-ligand interaction. Similarly, it is conceivable that the affinity of a mAb for a surface receptor could determine the nature of intracellular signaling and whether the mAb may deliver an agonist or an antagonist signal. The affinity-based nature of mAb-mediated signaling may have an impact of its side-effect profile. Therefore, the desired affinity and desired functions of therapeutic monoclonal antibodies need to be determined carefully by in vitro and in vivo experimentation.

The desired Kd of a binding protein (e.g., an antibody) may be determined experimentally depending on the desired therapeutic outcome. In an embodiment, parent antibodies with affinity (Kd) for a particular antigen equal to, or better than, the desired affinity of the DVD-binding protein for the same antigen are selected. The antigen binding affinity and kinetics are assessed by Biacore or another similar technique. In one embodiment, each parent antibody has a dissociation constant (Kd) to its antigen of: at most about $10^{-7}$ M; at most about $10^{-8}$ M; at most about $10^{-9}$ M; at most about $10^{-10}$ M; at most about $10^{-11}$ M; at most about $10^{-12}$ M; or at most $10^{-13}$ M. First parent antibody from which VD1 is obtained and second parent antibody from which VD2 is obtained may have similar or different affinity ($K_D$) for the respective antigen. Each parent antibody has an on rate constant (Kon) to the antigen of: at least about $10^2 M^{-1} s^{-1}$; at least about $10^3 M^{-1} s^{-1}$; at least about $10^4 M^{-1} s^{-1}$; at least about $10^5 M^{-1} s^{-1}$; or at least about $10^6 M^{-1} s^{-1}$, as measured by surface plasmon resonance. The first parent antibody from which, for example, a VD1 is obtained and the second parent antibody from which a VD2 is obtained may have similar or different on rate constant (Kon) for the respective antigen. In one embodiment, each parent antibody has an off rate constant (Koff) to the antigen of: at most about $10^{-3} s^{-1}$; at most about $10^{-4} s^{-1}$; at most about $10^{-5} s^{-1}$; or at most about $10^{-6} s^{-1}$, as measured by surface plasmon resonance. The first parent antibody from which VD1 is obtained and the second parent antibody from which VD2 is obtained may have similar or different off rate constants (Koff) for the respective antigen.

III.B.2. Potency

The desired affinity/potency of parental monoclonal antibodies will depend on the desired therapeutic outcome. For example, for receptor-ligand (R-L) interactions the affinity (kd) is equal to or better than the R-L kd (pM range). For simple clearance of a pathologic circulating proteins, the Kd could be in low nM range, e.g., clearance of various species of circulating A-β peptide. In addition, the Kd will also depend on whether the target expresses multiple copies of the same epitope, e.g., an mAb targeting conformational epitope in Aβ oligomers.

Where VD1 and VD2 bind the same antigen, but distinct epitopes, the DVD-binding protein will contain binding sites for the same antigen, thus increasing avidity and thereby the apparent Kd of the DVD-binding protein. In an embodiment, parent antibodies with equal or lower Kd than that desired in the DVD-binding protein are chosen. The affinity considerations of a parental mAb may also depend upon whether the DVD-binding protein contains four or more identical antigen binding sites (i.e., a DVD-binding protein from a single mAb). In this case, the apparent Kd would be greater than the mAb due to avidity. Such DVD-binding proteins can be employed for cross-linking surface receptor, increased neutralization potency, enhanced clearance of pathological proteins, etc.

In another embodiment, parent antibodies with neutralization potency for specific antigen equal to or better than the desired neutralization potential of the DVD-binding protein for the same antigen are selected. The neutralization potency can be assessed by a target-dependent bioassay where cells of appropriate type produce a measurable signal (i.e., proliferation or cytokine production) in response to target stimulation, and target neutralization by the mAb can reduce the signal in a dose-dependent manner.

III.B.3. Biological Functions

Monoclonal antibodies can perform potentially several functions. Some of these functions are listed in Table 4. These functions can be assessed by both in vitro assays (e.g., cell-based and biochemical assays) and in vivo animal models.

TABLE 4

Some Potential Applications For Therapeutic Antibodies.

| Target (Class) | Mechanism of Action (target) |
| --- | --- |
| Soluble (cytokines, other) | Neutralization of activity (e.g., a cytokine, such SOST) Enhance clearance (e.g., Aβ oligomers) Increase half-life (e.g., GLP 1) |
| Cell Surface (Receptors, other) | Agonist (e.g., GLP1 R, EPO R, etc.) Antagonist (e.g., integrins, etc.) Cytotoxic (CD 20, etc.) |
| Protein deposits | Enhance clearance/degradation (e.g., Aβ plaques, amyloid deposits) |

MAbs with distinct functions described in the examples herein and in Table 8 can be selected to achieve desired therapeutic outcomes. Two or more selected parent monoclonal antibodies can then be used in DVD-binding protein format to achieve two distinct functions in a single DVD-binding protein. For example, a DVD-binding protein can be generated by selecting a parent mAb that neutralizes function of a specific cytokine, such as sclerostin, and selecting a parent mAb that enhances clearance of a pathological protein. Similarly, two parent mAbs may be selected that recognize two different cell surface receptors, one mAb with an agonist function on one receptor and the other mAb with an antagonist function on a different receptor. These two selected mAbs, each with a distinct function, can be used to construct a single DVD-binding protein that will possess the two distinct functions (agonist and antagonist) of the selected monoclonal antibodies in a single molecule. Similarly, two antagonistic mAbs to cell surface receptors, each blocking binding of respective receptor ligands (e.g., EGF and IGF), may be used in a DVD-binding protein format. Conversely, an antagonistic anti-receptor mAb (e.g., anti-EGFR) and a neutralizing anti-soluble mediator (e.g., anti-IGF1/2) mAb can be selected to make a DVD-binding protein.

III.B.4. Epitope Recognition:

Different regions of proteins may perform different functions. For example, specific regions of a cytokine, such as sclerostin, interact with the cytokine receptor to bring about receptor activation whereas other regions of the protein may be required for stabilizing the cytokine. In this instance, one may select a mAb that binds specifically to the receptor interacting region(s) on the cytokine and thereby block cytokine-receptor interaction. In some cases, for example certain chemokine receptors that bind multiple ligands, a mAb that binds to the epitope (region on chemokine receptor) that interacts with only one ligand can be selected. In other instances, monoclonal antibodies can bind to epitopes on a target that are not directly responsible for physiological functions of the protein, but binding of a mAb to these regions could either interfere with physiological functions (steric hindrance) or alter the conformation of the protein such that the protein cannot function (mAb to receptors with multiple ligand which alter the receptor conformation such that none of the ligand can bind). Anti-cytokine monoclonal antibodies that do not block binding of the cytokine to its receptor, but block signal transduction have also been identified (e.g., 125-2H, an anti-IL-18 mAb).

Examples of epitopes and mAb functions include, but are not limited to, blocking Receptor-Ligand (R-L) interaction (neutralizing mAb that binds R-interacting site); steric hindrance resulting in diminished or no R-binding. An antibody can bind the target at a site other than a receptor binding site, but still interfere with receptor binding and functions of the target by inducing conformational change and eliminate function (e.g., XOLAIR® omalizumab, Genetech/Novartis), binding to R but block signaling (125-2H mAb).

In an embodiment, the parental mAb needs to target the appropriate epitope for maximum efficacy. Such epitope should be conserved in the DVD-binding protein. The binding epitope of a mAb can be determined by several approaches, including co-crystallography, limited proteolysis of mAb-antigen complex plus mass spectrometric peptide mapping (Legros V. et al 2000 Protein Sci. 9:1002-10), phage displayed peptide libraries (O'Connor K H et al 2005 J Immunol Methods. 299:21-35), as well as mutagenesis (Wu C. et al. 2003 J Immunol 170:5571-7).

III.B.5. Physicochemical and Pharmaceutical Properties:

Therapeutic treatment with antibodies often requires administration of high doses, often several mg/kg (due to a low potency on a mass basis as a consequence of a typically large molecular weight). In order to accommodate patient compliance and to adequately address chronic disease therapies and outpatient treatment, subcutaneous (s.c.) or intramuscular (i.m.) administration of therapeutic mAbs is desirable. For example, the maximum desirable volume for s.c administration is ~1.0 mL, and therefore, concentrations of >100 mg/mL are desirable to limit the number of injections per dose. In an embodiment, the therapeutic antibody is administered in one dose. The development of such formulations is constrained, however, by protein-protein interactions (e.g., aggregation, which potentially increases immunogenicity risks) and by limitations during processing and delivery (e.g., viscosity). Consequently, the large quantities required for clinical efficacy and the associated development constraints limit full exploitation of the potential of antibody formulation and s.c administration in high-dose regimens. It is apparent that the physicochemical and pharmaceutical properties of a protein molecule and the protein solution are of utmost importance, e.g., stability, solubility and viscosity features.

III.B.5.i. Stability

A "stable" antibody formulation is one in which the antibody therein essentially retains its physical stability and/or chemical stability and/or biological activity upon storage. Stability can be measured at a selected temperature for a selected time period. In an embodiment, the antibody in the formulation is stable at room temperature (about 30° C.) or at 40° C. for at least 1 month and/or stable at about 2-8° C. for at least 1 year for at least 2 years. Furthermore, in an embodiment, the formulation is stable following freezing (to, e.g., −70° C.) and thawing of the formulation, hereinafter referred to as a "freeze/thaw cycle." In another example, a "stable" formulation may be one wherein less than about 10% and less than about 5% of the protein is present as an aggregate in the formulation.

A DVD-binding protein stable in vitro at various temperatures for an extended time period is desirable. One can achieve this by rapid screening of parental mAbs stable in vitro at elevated temperature, e.g., at 40° C. for 2-4 weeks, and then assess stability. During storage at 2-8° C., the protein reveals stability for at least 12 months, e.g., at least 24 months. Stability (% of monomeric, intact molecule) can be assessed using various techniques such as cation exchange chromatography, size exclusion chromatography, SDS-PAGE, as well as bioactivity testing. For a more comprehensive list of analytical techniques that may be employed to analyze covalent and conformational modifications, see, Jones, A. J. S. (1993) "Analytical methods for the assessment of protein formulations and delivery systems," In Cleland, J. L.; Langer, R., editors. Formulation and delivery of peptides and proteins, 1st edition (Washington, ACS), pages 22-45; and Pearlman, R.; Nguyen, T. H. (1990) "Analysis of protein drugs," In Lee, V. H., editor. Peptide and protein drug delivery, 1st edition (New York, Marcel Dekker, Inc.), pages 247-301.

Heterogeneity and aggregate formation: stability of the antibody may be such that the formulation may reveal less than about 10%, and, in an embodiment, less than about 5%, in another embodiment, less than about 2%, or, in an embodiment, within the range of 0.5% to 1.5% or less in the GMP antibody material that is present as aggregate. Size exclusion chromatography is a method that is sensitive, reproducible, and very robust in the detection of protein aggregates.

In addition to low aggregate levels, the antibody must, in an embodiment, be chemically stable. Chemical stability may be determined by ion exchange chromatography (e.g., cation or anion exchange chromatography), hydrophobic interaction chromatography, or other methods such as isoelectric focusing or capillary electrophoresis. For instance, chemical stability of the antibody may be such that after storage of at least 12 months at 2-8° C. the peak representing unmodified antibody in a cation exchange chromatography may increase not more than 20%, in an embodiment, not more than 10%, or, in another embodiment, not more than 5% as compared to the antibody solution prior to storage testing.

In an embodiment, the parent antibodies display structural integrity; correct disulfide bond formation, and correct folding: Chemical instability due to changes in secondary or tertiary structure of an antibody may impact antibody activity. For instance, stability as indicated by activity of the antibody may be such that after storage of at least 12 months at 2-8° C. the activity of the antibody may decrease not more than 50%, in an embodiment not more than 30%, or even not more than 10%, or in an embodiment not more than 5% or 1% as compared to the antibody solution prior to storage testing. Suitable antigen-binding assays can be employed to determine antibody activity.

III.B.5.ii. Solubility:

The "solubility" of a mAb correlates with the production of correctly folded, monomeric IgG. The solubility of the IgG may therefore be assessed by HPLC. For example, soluble (monomeric) IgG will give rise to a single peak on the HPLC chromatograph, whereas insoluble (e.g., multimeric and aggregated) will give rise to a plurality of peaks. A person skilled in the art will therefore be able to detect an increase or decrease in solubility of an IgG using routine HPLC techniques. For a more comprehensive list of analytical techniques that may be employed to analyze solubility (see, Jones, A. G. Dep. Chem. Biochem. Eng., Univ. Coll. London, London, UK. Editor(s): Shamlou, P. Ayazi, Process. Solid-Liquid Suspensions (1993), 93-117. (Butterworth-Heinemann, Oxford, UK) and Pearlman, Rodney; Nguyen, Tue H, Advances in Parenteral Sciences (1990), 4 (Pept. Protein Drug Delivery), 247-301. Solubility of a therapeutic mAb is critical for formulating to high concentration often required for adequate dosing. As outlined herein, solubilities of >100 mg/mL may be required to accommodate efficient antibody dosing. For instance, antibody solubility may be not less than about 5 mg/mL in early research phase, in an embodiment not less than about 25 mg/mL in advanced process science stages, or in an embodiment not less than about 100 mg/mL, or in an embodiment not less than about 150 mg/mL. The intrinsic properties of a protein molecule are important to the physicochemical properties of the protein solution, e.g., stability, solubility, viscosity. However, a person skilled in the art will appreciate that a broad variety of excipients exist that may be used as additives to beneficially impact the characteristics of the final protein formulation. These excipients may include: (i) liquid solvents, cosolvents (e.g., alcohols such as ethanol); (ii) buffering agents (e.g., phosphate, acetate, citrate, amino acid buffers); (iii) sugars or sugar alcohols (e.g., sucrose, trehalose, fructose, raffinose, mannitol, sorbitol, dextrans); (iv) surfactants (e.g., polysorbate 20, 40, 60, 80, poloxamers); (v) isotonicity modifiers (e.g., salts such as NaCl, sugars, sugar alcohols); and (vi) others (e.g., preservatives, chelating agents, antioxidants, chelating substances (e.g., EDTA), biodegradable polymers, carrier molecules (e.g., HSA, PEGs)

Viscosity is a parameter of high importance with regard to antibody manufacture and antibody processing (e.g., diafiltration/ultrafiltration), fill-finish processes (pumping aspects, filtration aspects) and delivery aspects (syringeability, sophisticated device delivery). Low viscosities enable the liquid solution of the antibody having a higher concentration. This enables the same dose to be administered in smaller volumes. Small injection volumes inhere the advantage of lower pain on injection sensations, and the solutions do not necessarily have to be isotonic to reduce pain on injection in the patient. The viscosity of the antibody solution may be such that at shear rates of 100 (1/s) antibody solution viscosity is below 200 mPas, in an embodiment below 125 mPas, in another embodiment below 70 mPas, and in yet another embodiment below 25 mPas or even below 10 mPas.

III.B.5.iii. Production Efficiency

The generation of a DVD-binding protein that is efficiently expressed in mammalian cells, such as Chinese hamster ovary cells (CHO), will in an embodiment require two parental monoclonal antibodies which are themselves expressed efficiently in mammalian cells. The production yield from a stable mammalian line (i.e., CHO) should be above about 0.5 g/L, in an embodiment above about 1 g/L, and in another embodiment in the range of about 2 to about 5 g/L or more (Kipriyanov S M, Little M. 1999 Mol. Biotechnol. 12:173-201; Carroll S, Al-Rubeai M. 2004 Expert Opin Biol Ther. 4:1821-9).

Production of antibodies and Ig fusion proteins in mammalian cells is influenced by several factors. Engineering of the expression vector via incorporation of strong promoters, enhancers and selection markers can maximize transcription of the gene of interest from an integrated vector copy. The identification of vector integration sites that are permissive for high levels of gene transcription can augment protein expression from a vector (Wurm et al, 2004, *Nature Biotechnology*, 2004, 22(11): 1393-1398). Furthermore, levels of production are affected by the ratio of antibody heavy and light chains and various steps in the process of protein assembly and secretion (Jiang et al. 2006, Biotechnology Progress, January-February 2006, vol. 22, no. 1, pp. 313-318).

III.B.6. Immunogenicity

Administration of a therapeutic mAb may result in certain incidence of an immune response (i.e., the formation of endogenous antibodies directed against the therapeutic mAb). Potential elements that might induce immunogenicity should be analyzed during selection of the parental monoclonal antibodies, and steps to reduce such risk can be taken to optimize the parental monoclonal antibodies prior to DVD-binding protein construction. Mouse-derived antibodies have been found to be highly immunogenic in patients. The generation of chimeric antibodies comprised of mouse variable and human constant regions presents a logical next step to reduce the immunogenicity of therapeutic antibodies (Morrison and Schlom, 1990). Alternatively, immunogenicity can be reduced by transferring murine CDR sequences into a human antibody framework (reshaping/CDR grafting/humanization), as described for a therapeutic antibody by Riechmann et al., 1988. Another method is referred to as "resurfacing" or "veneering", starting with the rodent variable light and heavy domains, only surface-accessible framework amino acids are altered to human ones, while the CDR and buried amino acids remain from the parental rodent antibody (Roguska et al., 1996). In another type of humanization, instead of grafting the entire CDRs, one technique grafts only the "specificity-determining regions" (SDRs), defined as the subset of CDR residues that are involved in binding of the antibody to its target (Kashmiri et al., 2005). This necessitates identification of the SDRs either through analysis of available three-dimensional structures of antibody-target complexes or mutational analysis of the antibody CDR residues to determine which interact with the target. Alternatively, fully human antibodies may have reduced immunogenicity compared to murine, chimeric, or humanized antibodies.

Another approach to reduce the immunogenicity of therapeutic antibodies is the elimination of certain specific sequences that are predicted to be immunogenic. In one approach, after a first generation biologic has been tested in humans and found to be unacceptably immunogenic, the B-cell epitopes can be mapped and then altered to avoid immune detection. Another approach uses methods to predict and remove potential T-cell epitopes. Computational methods have been developed to scan and to identify the peptide sequences of biologic therapeutics with the potential to bind to MHC proteins (Desmet et al., 2005). Alternatively a human dendritic cell-based method can be used to identify CD4+ T-cell epitopes in potential protein allergens (Stickler et al., 2005; S. L. Morrison and J. Schlom, *Important Adv. Oncol.* (1990), pp. 3-18; Riechmann, L, Clark, M., Waldmann, H. and Winter, G. "Reshaping human antibodies for therapy," *Nature* (1988) 332: 323-327; Roguska-M-A, Pedersen-J-T, Henry-A-H, Searle-S-M, Roja-C-M, Avery-B, Hoffee-M, Cook-S, Lambert-J-M, Blattler-W-A, Rees-A-R, Guild-B-C, "A comparison of two murine mAbs humanized by CDR-grafting and variable domain resurfacing," *Protein Engineering*, (1996), 9:. 895-904; Kashmiri-Syed-V-S, De-Pascalis-Roberto, Gonzales-Noreen-R, Schlom-Jeffrey, "SDR grafting—a new approach to antibody humanization," *Methods* (San Diego Calif.), May 2005, 36(1): 25-34; Desmet-Johan, Meersseman-Geert, Boutonnet-Nathalie, Pletinckx-Jurgen, De-Clercq-Krista, Debulpaep-Maja, Braeckman-Tessa, Lasters-Ignace, "Anchor profiles of HLA-specific peptides: analysis by a novel affinity scoring method and experimental validation," *Proteins* (2005) 58: 53-69; Stickler-M-M, Estell-D-A, Harding-F-A., "CD4+ T-cell epitope determination using unexposed human donor peripheral blood mononuclear cells," *J. Immunother.* (2000) 23: 654-60.)

III.B.7. In Vivo Efficacy

To generate a DVD-binding protein with desired in vivo efficacy, it is important to generate and select mAbs with similarly desired in vivo efficacy when given in combination. However, in some instances the DVD-binding protein may exhibit in vivo efficacy that cannot be achieved with the combination of two separate mAbs. For instance, a DVD-binding protein may bring two targets in close proximity leading to an activity that cannot be achieved with the combination of two separate mAbs. Additional desirable biological functions are described herein in section B3. Parent antibodies with characteristics desirable in the DVD-binding protein may be selected based on factors such as pharmacokinetic half-life (t½); tissue distribution; soluble versus cell surface targets; and target concentration-soluble/density-surface.

III.B.8. In Vivo Tissue Distribution

To generate a DVD-binding protein with desired in vivo tissue distribution, in an embodiment, parent mAbs with similar desired in vivo tissue distribution profile must be selected. Alternatively, based on the mechanism of the dual-specific targeting strategy, it may at other times not be required to select parent mAbs with the similarly desired in vivo tissue distribution when given in combination. For instance, in the case of a DVD-binding protein in which one binding component targets the DVD-binding protein to a specific site thereby bringing the second binding component to the same target site. For example, one binding specificity of a DVD-binding protein could target pancreas (islet cells) and the other specificity could bring GLP1 to the pancreas to induce insulin.

III.B.9. Isotype

To generate a DVD-binding protein with desired properties including, but not limited to, isotype, effector functions, and the circulating half-life, parent mAbs are selected that possess appropriate Fc-effector functions depending on the therapeutic utility and the desired therapeutic end-point. There are five main heavy chain classes or isotypes, some of which have several sub-types and these determine the effector functions of an antibody molecule. These effector functions reside in the hinge region, CH2, and CH3 domains of the antibody molecule. However, residues in other parts of an antibody molecule may have effects on effector functions as well. The hinge region Fc-effector functions include: (i) antibody-dependent cellular cytotoxicity (ADCC), (ii) complement (C1q) binding, activation, and complement-dependent cytotoxicity (CDC), (iii) phagocytosis/clearance of antigen-antibody complexes, and (iv) cytokine release in some instances. These Fc-effector functions of an antibody molecule are mediated through the interaction of the Fc-region with a set of class-specific cell surface receptors. Antibodies of the IgG1 isotype are most active while IgG2 and IgG4 having minimal or no effector functions. The effector functions of the IgG antibodies are mediated through interactions with three structurally homologous cellular Fc receptor types (and sub-types) (FcgR1, FcgRII, and FcgRIII). These effector functions of an IgG1 can be eliminated by mutating specific amino acid residues in the lower hinge region (e.g., L234A, L235A) that are required for FcgR and C1q binding Amino acid residues in the Fc region, in particular the CH2—CH3 domains, also determine the circulating half-life of the antibody molecule. This Fc function is mediated through the binding of the Fc-region to the neonatal Fc receptor (FcRn), which is responsible for recycling of antibody molecules from the acidic lysosomes back to the general circulation.

Whether a mAb should have an active or an inactive isotype will depend on the desired therapeutic end-point for an antibody. Some examples of usage of isotypes and desired therapeutic outcome are listed below:

1. If the desired end-point is functional neutralization of a soluble cytokine then an inactive isotype may be used;
2. If the desired out-come is clearance of a pathological protein an active isotype may be used;
3. If the desired out-come is clearance of protein aggregates an active isotype may be used;
4. If the desired outcome is to antagonize a surface receptor an inactive isotype is used (Tysabri, IgG4; OKT3®, mutated IgG1);
5. If the desired outcome is to eliminate target cells an active isotype is used (Herceptin, IgG1 (and with enhanced effector functions); and
6. If the desired outcome is to clear proteins from circulation without entering the CNS an IgM isotype may be used (e.g., clearing circulating Ab peptide species).

The Fc effector functions of a parental mAb can be determined by various in vitro methods well known in the art.

As discussed, the selection of isotype, and thereby the effector functions will depend upon the desired therapeutic end-point. In cases where simple neutralization of a circulating target is desired, for example blocking receptor-ligand interactions, the effector functions may not be required. In such instances, isotypes or mutations in the Fc-region of an antibody that eliminate effector functions are desirable. In other instances where elimination of target cells is the therapeutic end-point, for example elimination of tumor cells, isotypes or mutations or de-fucosylation in the Fc-region that enhance effector functions are desirable (Presta G L, *Adv. Drug Delivery Rev.*, 58: 640-656, 2006; Satoh M., Lida S., shitara K., *Expert Opinion Biol. Ther.*, 6: 1161-1173, 2006). Similarly, depending up on the therapeutic utility, the circulating half-life of an antibody molecule can be reduced/prolonged by modulating antibody-FcRn interactions by introducing specific mutations in the Fc region (Dall'Acqua W F, Kiener P A, Wu H., *J. Biol. Chem.*, 281: 23514-23524 (2006); Petkova S B., Akilesh S., Sproule T J. et al., *Internat. Immunol.*, 18: 1759-1769 (2006); Vaccaro C., Bawdon R., Wanjie S et al., *Proc. Natl. Acad. Sci. USA*, 103: 18709-18714 (2007).

The published information on the various residues that influence the different effector functions of a normal therapeutic mAb may need to be confirmed for a DVD-binding protein. It may be possible that in a DVD-binding protein format additional (different) Fc-region residues, other than those identified for the modulation of monoclonal antibody effector functions, may be important.

Overall, the decision as to which Fc-effector functions (isotype) will be critical in the final DVD-binding protein format will depend upon the disease indication, therapeutic target, desired therapeutic end-point, and safety considerations. Listed below are exemplary appropriate heavy chain and light chain constant regions including, but not limited to:

IgG1—allotype: G1mz
IgG1 mutant—A234, A235
IgG2—allotype: G2m(n−)
Kappa—Km3
Lambda Fc Receptor and C1q Studies:

The possibility of unwanted antibody-dependent cell-mediated cytotoxicity (ADCC) and complement-dependent cytotoxicity (CDC) by antibody complexing to any overexpressed target on cell membranes can be abrogated by (for example, L234A, L235A) hinge-region mutations. These substituted amino acids, present in the IgG1 hinge region of mAb, are expected to result in diminished binding of mAb to human Fc receptors (but not FcRn), as FcgR binding is thought to occur within overlapping sites on the IgG1 hinge region. This feature of mAb may lead to an improved safety profile over antibodies containing a wild-type IgG. Binding of mAb to human Fc receptors can be determined by flow cytometry experiments using cell lines (e.g., THP-1, K562) and an engineered CHO cell line that expresses FcgRIIb (or other FcgRs). Compared to IgG1 control monoclonal antibodies, mAb show reduced binding to FcgRI and FcgRIIa whereas binding to FcgRIIb is unaffected. The binding and activation of C1q by antigen/IgG immune complexes triggers the classical complement cascade with consequent inflammatory and/or immunoregulatory responses. The C1q binding site on IgGs has been localized to residues within the IgG hinge region. C1q binding to increasing concentrations of mAb was assessed by C1q ELISA. The results demonstrate that mAb is unable to bind to C1q, as expected when compared to the binding of a wildtype control IgG1. Overall, the L234A, L235A hinge region mutation abolishes binding of mAb to FcgRI, FcgRIIa, and C1q, but does not impact the interaction of mAb with FcgRIIb. These data suggest that in vivo mAb with mutant Fc will interact normally with the inhibitory FcgRIIb but will likely fail to interact with the activating FcgRI and FcgRIIa receptors or C1q.

Human FcRn Binding: The neonatal receptor (FcRn) is responsible for transport of IgG across the placenta and to control the catabolic half-life of the IgG molecules. It might be desirable to increase the terminal half-life of an antibody to improve efficacy, to reduce the dose or frequency of administration, or to improve localization to the target. Alternatively, it might be advantageous to do the converse that is, to decrease the terminal half-life of an antibody to reduce whole body exposure or to improve the target-to-non-target binding ratios. Tailoring the interaction between IgG and its salvage receptor, FcRn, offers a way to increase or decrease the terminal half-life of IgG. Proteins in the circulation, including IgG, are taken up in the fluid phase through micropinocytosis by certain cells, such as those of the vascular endothelia. IgG can bind FcRn in endosomes under slightly acidic conditions (pH 6.0-6.5) and can recycle to the cell surface, where it is released under almost neutral conditions (pH 7.0-7.4). Mapping of the Fc-region-binding site on FcRn80, 16, 17 showed that two histidine residues that are conserved across species, His310 and His435, are responsible for the pH dependence of this interaction. Using phage-display technology, a mouse Fc-region mutation that increases binding to FcRn and extends the half-life of mouse IgG was identified (see Victor, G. et al., *Nature Biotechnology,* 15(7): 637-640 (1997)). Fc-region mutations that increase the binding affinity of human IgG for FcRn at pH 6.0, but not at pH 7.4, have also been identified (see, Dall'Acqua et al., *J. Immunol.,* 169(9): 5171-80 (2002)). Moreover, in one case, a similar pH-dependent increase in binding (up to 27-fold) was also observed for rhesus FcRn, and this resulted in a twofold increase in serum half-life in rhesus monkeys compared with the parent IgG (see, Hinton et al., *J. Biol. Chem.,* 279(8): 6213-6216 (2004)). These findings indicate that it is feasible to extend the plasma half-life of antibody therapeutics by tailoring the interaction of the Fc region with FcRn. Conversely, Fc-region mutations that attenuate interaction with FcRn can reduce antibody half-life.

III.B.10. Pharmacokinetics (PK)

To generate a DVD-binding protein with desired pharmacokinetic profile, in an embodiment, parent mAbs with the similarly desired pharmacokinetic profile are selected. One consideration is that immunogenic response to monoclonal antibodies (i.e., "HAHA", human anti-human antibody response; "HACA", human anti-chimeric antibody response) further complicates the pharmacokinetics of these therapeutic agents. In an embodiment, monoclonal antibodies with minimal or no immunogenicity are used for constructing DVD-binding proteins such that the resulting DVD-binding proteins will also have minimal or no immunogenicity. Some of the factors that determine the PK of a mAb include, but are not limited to, intrinsic properties of the mAb (VH amino acid sequence); immunogenicity; FcRn binding and Fc functions.

The PK profile of selected parental monoclonal antibodies can be easily determined in rodents as the PK profile in rodents correlates well with (or closely predicts) the PK profile of monoclonal antibodies in cynomolgus monkey and humans.

After the parental monoclonal antibodies with desired PK characteristics (and other desired functional properties as discussed herein) are selected, the DVD-binding protein is constructed. As the DVD-binding proteins contain two antigen-binding domains from two parental monoclonal antibodies, the PK properties of the DVD-binding protein are assessed as well. Therefore, while determining the PK properties of the DVD-binding protein, PK assays may be employed that determine the PK profile based on functionality of both antigen-binding domains derived from the 2 parent monoclonal antibodies. The PK profile of a DVD-binding protein can be determined Additional factors that may impact the PK profile of DVD-binding protein include the antigen-binding domain (CDR) orientation, linker size, and Fc/FcRn interactions. PK characteristics of parent antibodies can be evaluated by assessing the following parameters: absorption, distribution, metabolism and excretion.

Absorption: To date, administration of therapeutic monoclonal antibodies is via parenteral routes (e.g., intravenous [IV], subcutaneous [SC], or intramuscular [IM]). Absorption of a mAb into the systemic circulation following either SC or IM administration from the interstitial space is primarily through the lymphatic pathway. Saturable, presystemic, proteolytic degradation may result in variable absolute bioavailability following extravascular administration. Usually, increases in absolute bioavailability with increasing doses of monoclonal antibodies may be observed due to saturated proteolytic capacity at higher doses. The absorption process for a mAb is usually quite slow as the lymph fluid drains slowly into the vascular system, and the duration of absorption may occur over hours to several days. The absolute bioavailability of monoclonal antibodies following SC administration generally ranges from 50% to 100%. In the case of a transport-mediating structure at the blood-brain barrier (BBB) targeted by the DVD-binding protein construct, circulation times in plasma may be reduced due to enhanced trans-cellular transport at the blood brain barrier (BBB) into the CNS compartment, where the DVD-binding protein is liberated to enable interaction via its second antigen recognition site.

Distribution: Following IV administration, monoclonal antibodies usually follow a biphasic serum (or plasma) concentration-time profile, beginning with a rapid distribution phase, followed by a slow elimination phase. In general, a biexponential pharmacokinetic model best describes this kind of pharmacokinetic profile. The volume of distribution in the central compartment (Vc) for a mAb is usually equal to or slightly larger than the plasma volume (2-3 liters). A distinct biphasic pattern in serum (plasma) concentration versus time profile may not be apparent with other parenteral routes of administration, such as IM or SC, because the distribution phase of the serum (plasma) concentration-time curve is masked by the long absorption portion. Many factors, including physicochemical properties, site-specific and target-oriented receptor mediated uptake, binding capacity of tissue, and mAb dose can influence biodistribution of a mAb. Some of these factors can contribute to nonlinearity in biodistribution for a mAb.

Metabolism and Excretion: Due to the molecular size, intact monoclonal antibodies are not excreted into the urine via kidney. They are primarily inactivated by metabolism (e.g., catabolism). For IgG-based therapeutic monoclonal antibodies, half-lives typically ranges from hours or 1-2 days to over 20 days. The elimination of a mAb can be affected by many factors, including, but not limited to, affinity for the FcRn receptor, immunogenicity of the mAb, the degree of glycosylation of the mAb, the susceptibility for the mAb to proteolysis, and receptor-mediated elimination.

III.B.11. Tissue Cross-Reactivity Pattern on Human and Tox Species

Identical staining pattern suggests that potential human toxicity can be evaluated in tox species. Tox species are those animal in which unrelated toxicity is studied.

The individual antibodies are selected to meet two criteria: (1) tissue staining appropriate for the known expression of the antibody target and (2) similar staining pattern between human and tox species tissues from the same organ.

Criterion 1: Immunizations and/or antibody selections typically employ recombinant or synthesized antigens (proteins, carbohydrates or other molecules). Binding to the natural counterpart and counterscreen against unrelated antigens are often part of the screening funnel for therapeutic antibodies. However, screening against a multitude of antigens is often unpractical. Therefore, tissue cross-reactivity studies with human tissues from all major organs serve to rule out unwanted binding of the antibody to any unrelated antigens.

Criterion 2: Comparative tissue cross reactivity studies with human and tox species tissues (cynomolgus monkey, dog, possibly rodents, and others, the same 36 or 37 tissues being tested as in the human study) help to validate the selection of a tox species. In the typical tissue cross-reactivity studies on frozen tissue sections, therapeutic antibodies may demonstrate the expected binding to the known antigen and/or to a lesser degree binding to tissues based either on low level interactions (unspecific binding, low level binding to similar antigens, low level charge based interactions, etc.). In any case, the most relevant toxicology animal species is the one with the highest degree of coincidence of binding to human and animal tissue.

Tissue cross-reactivity studies follow the appropriate regulatory guidelines including EC CPMP Guideline III/5271/94 "Production and quality control of mAbs" and the 1997 US FDA/CBER "Points to Consider in the Manufacture and Testing of Monoclonal Antibody Products for Human Use". Cryosections (5 µm) of human tissues obtained at autopsy or biopsy were fixed and dried on object glass. The peroxidase staining of tissue sections are performed, using the avidin-biotin system. FDA's Guidance "*Points to Consider in the Manufacture and Testing of Monoclonal Antibody Products for Human Use*". Relevant references include Clarke, J. (2004), Boon, L. (2002a), Boon, L. (2002b), Ryan, A. (1999).

Tissue-cross reactivity studies are often done in two stages, with the first stage including cryosections of 32 tissues (typically: Adrenal Gland, Gastrointestinal Tract, Prostate, Bladder, Heart, Skeletal Muscle, Blood Cells, Kidney, Skin, Bone Marrow, Liver, Spinal Cord, Breast, Lung, Spleen, Cerebellum, Lymph Node, Testes, Cerebral Cortex, Ovary, Thymus, Colon, Pancreas, Thyroid, Endothelium, Parathyroid, Ureter, Eye, Pituitary, Uterus, Fallopian Tube and Placenta) from one human donor. In the second phase, a full cross reactivity study is performed with up to 38 tissues (including adrenal, blood, blood vessel, bone marrow, cerebellum, cerebrum, cervix, esophagus, eye, heart, kidney, large intestine, liver, lung, lymph node, breast mammary gland, ovary, oviduct, pancreas, parathyroid, peripheral nerve, pituitary, placenta, prostate, salivary gland, skin, small intestine, spinal cord, spleen, stomach, striated muscle, testis, thymus, thyroid, tonsil, ureter, urinary bladder, and uterus) from three unrelated adults. Studies are done typically at minimally two dose levels.

The therapeutic antibody (i.e., test article) and isotype matched control antibody may be biotinylated for avidin-biotin complex (ABC) detection; other detection methods may include tertiary antibody detection for a FITC (or otherwise) labeled test article, or precomplexing with a labeled anti-human IgG for an unlabeled test article.

Briefly, cryosections (about 5 µm) of human tissues obtained at autopsy or biopsy are fixed and dried on object glass. The peroxidase staining of tissue sections is performed, using the avidin-biotin system. First (in case of a precomplexing detection system), the test article is incubated with the secondary biotinylated anti-human IgG and developed into immune complex. The immune complex at the final concentrations of 2 and 10 µg/mL of test article is added onto tissue sections on object glass and then the tissue sections were reacted for 30 minutes with a avidin-biotin-peroxidase kit. Subsequently, DAB (3,3'-diaminobenzidine), a substrate for the peroxidase reaction, was applied for 4 minutes for tissue staining. Antigen-Sepharose beads are used as positive control tissue sections.

Any specific staining is judged to be either an expected (e.g., consistent with antigen expression) or unexpected reactivity based upon known expression of the target antigen in question. Any staining judged specific is scored for intensity and frequency. Antigen or serum competition or blocking studies can assist further in determining whether observed staining is specific or nonspecific.

If two selected antibodies are found to meet the selection criteria—appropriate tissue staining, matching staining between human and toxicology animal specific tissue—they can be selected for DVD-binding protein generation.

The tissue cross-reactivity study has to be repeated with the final DVD-binding protein construct, but while these studies follow the same protocol as outline herein, they are more complex to evaluate because any binding can come from any of the two parent antibodies, and any unexplained binding needs to be confirmed with complex antigen competition studies.

It is readily apparent that the complex undertaking of tissue cross-reactivity studies with a multispecific molecule like a DVD-binding protein is greatly simplified if the two parental antibodies are selected for: (1) lack of unexpected tissue cross-reactivity findings and (2) appropriate similarity of tissue cross-reactivity findings between the corresponding human and toxicology animal species tissues.

III.B.12. Specificity and Selectivity

To generate a DVD-binding protein with desired specificity and selectivity, one needs to generate and select parent mAbs with the similarly desired specificity and selectivity profile.

Binding studies for specificity and selectivity with a DVD-binding protein can be complex due to the four or more binding sites, two each for each antigen. Briefly, binding studies using ELISA, BIAcore, KinExA, or other interaction studies with a DVD-binding protein need to monitor the binding of one, two, or more antigens to the DVD-binding protein. While BIAcore technology can resolve the sequential, independent binding of multiple antigens, more traditional methods including ELISA or more modern techniques like KinExA cannot. Therefore careful characterization of each parent antibody is critical. After each individual antibody has been characterized for specificity, confirmation of specificity retention of the individual binding sites in the DVD-binding protein is greatly simplified.

It is readily apparent that the complex undertaking of determining the specificity of a DVD-binding protein is greatly simplified if the two parental antibodies are selected for specificity prior to being combined into a DVD-binding protein.

Antigen-antibody interaction studies can take many forms, including many classical protein protein interaction studies, including ELISA (enzyme linked immunosorbent assay), mass spectrometry, chemical cross linking, SEC with light scattering, equilibrium dialysis, gel permeation, ultrafiltration, gel chromatography, large-zone analytical SEC, micro-preparative ultracentrifugation (sedimentation equilibrium), spectroscopic methods, titration microcalorimetry, sedimentation equilibrium (in analytical ultracentrifuge), sedimentation velocity (in analytical centrifuge), surface plasmon resonance (including BIAcore). Relevant references include "Current Protocols in Protein Science," John E. Coligan, Ben M. Dunn, David W. Speicher, Paul T, Wingfield (eds.) Volume 3, chapters 19 and 20, published by John Wiley & Sons Inc., and references included therein and "Current Protocols in Immunology," John E. Coligan, Barbara E. Bierer, David H. Margulies, Ethan M. Shevach, Warren Strober (eds.) published by John Wiley & Sons Inc and relevant references included therein.

Cytokine Release in Whole Blood: The interaction of mAb with human blood cells can be investigated by a cytokine release assay (Wing, M. G., *Therapeutic Immunology* (1995), 2(4): 183-190; "Current Protocols in Pharmacology," S. J. Enna, Michael Williams, John W. Ferkany, Terry Kenakin, Paul Moser, (eds.) published by John Wiley & Sons Inc; Madhusudan, S., *Clinical Cancer Research* (2004), 10(19): 6528-6534; Cox, *J. Methods* (2006), 38(4): 274-282; Choi, I., *Eur. J. Immunol.*, (2001), 31(1): 94-106). Briefly, various concentrations of mAb are incubated with human whole blood for 24 hours. The concentration tested should cover a wide range including final concentrations mimicking typical blood levels in patients (including but not limited to 100 ng/ml-100 µg/ml). Following the incubation, supernatants and cell lysates are analyzed for the presence of IL-1Rα, TNF-α, IL-1b, IL-6 and IL-8. Cytokine concentration profiles generated for mAb are compared to profiles produced by a negative human IgG control and a positive LPS or PHA control. The cytokine profile displayed by mAb from both cell supernatants and cell lysates are compared to that using control human IgG. In an embodiment, the monoclonal antibody does not interact with human blood cells to spontaneously release inflammatory cytokines.

Cytokine release studies for a DVD-binding protein are complex due to the four or more binding sites, two each for each antigen. Briefly, cytokine release studies as described herein measure the effect of the whole DVD-binding protein on whole blood or other cell systems, but cannot resolve which portion of the molecule causes cytokine release. Once cytokine release has been detected, the purity of the DVD-binding protein preparation has to be ascertained, because some co-purifying cellular components can cause cytokine release on their own. If purity is not the issue, fragmentation of DVD-binding protein (including but not limited to removal of Fc portion, separation of binding sites etc.), binding site mutagenesis or other methods may need to be employed to deconvolute any observations. It is readily apparent that this complex undertaking is greatly simplified if the two parental antibodies are selected for lack of cytokine release prior to being combined into a DVD-binding protein.

III.B.13. Cross Reactivity to Other Species for Toxicological Studies

In an embodiment, the individual antibodies selected with sufficient cross-reactivity to appropriate tox species, for example, cynomolgus monkey. Parental antibodies need to bind to orthologous species target (i.e. cynomolgus monkey) and elicit appropriate response (modulation, neutralization, activation). In an embodiment, the cross-reactivity (affinity/potency) to orthologous species target should be within 10-fold of the human target. In practice, the parental antibodies are evaluated for multiple species, including mouse, rat, dog, monkey (and other non-human primates), as well as disease model species (i.e. sheep for asthma model). The acceptable cross-reactivity to tox species from the parental monoclonal antibodies allows future toxicology studies of DVD-binding protein in the same species. For that reason, the two parental monoclonal antibodies should have acceptable cross-reactivity for a common tox species therefore allowing toxicology studies of DVD-binding protein in the same species.

Parent mAbs may be selected from various mAbs capable of binding specific targets and well known in the art. These include, but are not limited to anti-sclerostin, anti-SOSTF, anti-TNF antibody (U.S. Pat. No. 6,258,562), anti-IL-12 and/or anti-IL-12p40 antibody (U.S. Pat. No. 6,914,128); anti-IL-18 antibody (US patent application publication No. 2005/0147610 A1), anti-C5, anti-CBL, anti-CD147, anti-gp120, anti-VLA-4, anti-CD11a, anti-CD18, anti-VEGF, anti-CD40L, anti CD-40 (e.g., see WO2007124299) anti-Id, anti-ICAM-1, anti-CXCL13, anti-CD2, anti-EGFR, anti-TGF-beta 2, anti-HGF, anti-cMet, anti DLL-4, anti-NPR1, anti-PLGF, anti-ErbB3, anti-E-selectin, anti-Fact VII, anti-Her2/neu, anti-F gp, anti-CD11/18, anti-CD14, anti-ICAM-3, anti-RON, anti CD-19, anti-CD80 (e.g., see PCT Publication No.

WO 2003/039486), anti-CD4, anti-CD3, anti-CD23, anti-beta2-integrin, anti-alpha4beta7, anti-CD52, anti-HLA DR, anti-CD22 (see, e.g., U.S. Pat. No. 5,789,554), anti-CD20, anti-MIF, anti-CD64 (FcR), anti-TCR alpha beta, anti-CD2, anti-Hep B, anti-CA 125, anti-EpCAM, anti-gp120, anti-CMV, anti-gpIIbIIIa, anti-IgE, anti-CD25, anti-CD33, anti-HLA, anti-IGF1,2, anti IGFR, anti-VNRintegrin, anti-IL-1alpha, anti-IL-1beta, anti-IL-1 receptor, anti-IL-2 receptor, anti-IL-4, anti-IL-4 receptor, anti-IL5, anti-IL-5 receptor, anti-IL-6, anti-IL-6R, RANKL, NGF, DKK, alphaVbeta3, anti-IL-8, anti-IL-9, anti-IL-13, anti-IL-13 receptor, and anti-IL-23; IL-23p19; (see, Presta, "Selection, design, and engineering of therapeutic antibodies," J. Allergy Clin. Immunol., 116: 731-736 (2005) and at worldwide website hwww.path.cam.ac.uk/~mrc7/humanisation/antibodies.html).

Parent mAbs may also be selected from various therapeutic antibodies approved for use, in clinical trials, or in development for clinical use. Such therapeutic antibodies include, but are not limited to, rituximab (Rituxan®, IDEC/Genentech/Roche) (see for example U.S. Pat. No. 5,736,137), a chimeric anti-CD20 antibody approved to treat Non-Hodgkin's lymphoma; HuMax-CD20, an anti-CD20 antibody currently being developed by Genmab, an anti-CD20 antibody described in U.S. Pat. No. 5,500,362, AME-133 (Applied Molecular Evolution), hA20 (Immunomedics, Inc.), HumaLYM (Intracel), and PRO70769 (PCT/US2003/040426, entitled "Immunoglobulin Variants and Uses Thereof"), trastuzumab (Herceptin®, Genentech) (see for example U.S. Pat. No. 5,677,171), a humanized anti-Her2/neu antibody approved to treat breast cancer; pertuzumab (rhuMab-2C4, Omnitarg®), currently being developed by Genentech; an anti-Her2 antibody described in U.S. Pat. No. 4,753,894; cetuximab (Erbitux®, Imclone) (U.S. Pat. No. 4,943,533; PCT WO 96/40210), a chimeric anti-EGFR antibody in clinical trials for a variety of cancers; ABX-EGF (U.S. Pat. No. 6,235,883), currently being developed by Abgenix-Immunex-Amgen; HuMax-EGFr (U.S. Ser. No. 10/172,317), currently being developed by Genmab; 425, EMD55900, EMD62000, and EMD72000 (Merck KGaA) (U.S. Pat. No. 5,558,864; Murthy et al. 1987, Arch Biochem Biophys. 252(2):549-60; Rodeck et al., 1987, J Cell Biochem. 35(4):315-20; Kettleborough et al., 1991, Protein Eng. 4(7):773-83); ICR62 (Institute of Cancer Research) (PCT WO 95/20045; Modjtahedi et al., 1993, J. Cell Biophys. 1993, 22(1-3):129-46; Modjtahedi et al., 1993, Br J. Cancer. 1993, 67(2):247-53; Modjtahedi et al, 1996, Br J Cancer, 73(2):228-35; Modjtahedi et al, 2003, Int J Cancer, 105(2):273-80); TheraCIM hR3 (YM Biosciences, Canada and Centro de Immunologia Molecular, Cuba (U.S. Pat. No. 5,891,996; U.S. Pat. No. 6,506,883; Mateo et al, 1997, Immunotechnology, 3(1):71-81); mAb-806 (Ludwig Institute for Cancer Research, Memorial Sloan-Kettering) (Jungbluth et al. 2003, Proc Natl Acad Sci USA. 100(2):639-44); KSB-102 (KS Biomedix); MR1-1 (IVAX, National Cancer Institute) (PCT WO 0162931A2); and SC100 (Scancell) (PCT WO 01/88138); alemtuzumab (Campath®, Millenium), a humanized mAb currently approved for treatment of B-cell chronic lymphocytic leukemia; muromonab-CD3 (Orthoclone OKT3®), an anti-CD3 antibody developed by Ortho Biotech/Johnson & Johnson, ibritumomab tiuxetan (Zevalin®), an anti-CD$_2$O antibody developed by IDEC/Schering AG, gemtuzumab ozogamicin (Mylotarg®), an anti-CD33 (p67 protein) antibody developed by Celltech/Wyeth, alefacept (Amevive®), an anti-LFA-3 Fc fusion developed by Biogen), abciximab (ReoPro®), developed by Centocor/Lilly, basiliximab (Simulect®), developed by Novartis, palivizumab (Synagis®), developed by Medimmune, infliximab (Remicade®), an anti-TNFalpha antibody developed by Centocor, adalimumab (Humira®), an anti-TNFalpha antibody developed by Abbott, Humicade®, an anti-TNFalpha antibody developed by Celltech, golimumab (CNTO-148), a fully human TNF antibody developed by Centocor, etanercept (Enbrel®), an p75 TNF receptor Fc fusion developed by Immunex/Amgen, lenercept, an p55TNF receptor Fc fusion previously developed by Roche, ABX-CBL, an anti-CD147 antibody being developed by Abgenix, ABX-IL8, an anti-IL8 antibody being developed by Abgenix, ABX-MA1, an anti-MUC 18 antibody being developed by Abgenix, Pemtumomab (R1549, 90Y-muHMFG1), an anti-MUC1 in development by Antisoma, Therex (R1550), an anti-MUC1 antibody being developed by Antisoma, AngioMab (AS 1405), being developed by Antisoma, HuBC-1, being developed by Antisoma, Thioplatin (AS 1407) being developed by Antisoma, Antegren® (natalizumab), an anti-alpha-4-beta-1 (VLA-4) and alpha-4-beta-7 antibody being developed by Biogen, VLA-1 mAb, an anti-VLA-1 integrin antibody being developed by Biogen, LTBR mAb, an anti-lymphotoxin beta receptor (LTBR) antibody being developed by Biogen, CAT-152, an anti-TGF-β2 antibody being developed by Cambridge Antibody Technology, ABT 874 (J695), an anti-IL-12 p40 antibody being developed by Abbott, CAT-192, an anti-TGFf31 antibody being developed by Cambridge Antibody Technology and Genzyme, CAT-213, an anti-Eotaxinl antibody being developed by Cambridge Antibody Technology, LymphoStat-B® an anti-Blys antibody being developed by Cambridge Antibody Technology and Human Genome Sciences Inc., TRAIL-R1 mAb, an anti-TRAIL-R1 antibody being developed by Cambridge Antibody Technology and Human Genome Sciences, Inc., Avastin® bevacizumab, rhuMAb-VEGF), an anti-VEGF antibody being developed by Genentech, an anti-HER receptor family antibody being developed by Genentech, Anti-Tissue Factor (ATF), an anti-Tissue Factor antibody being developed by Genentech, Xolair® (Omalizumab), an anti-IgE antibody being developed by Genentech, Raptiva® (Efalizumab), an anti-CD11a antibody being developed by Genentech and Xoma, MLN-02 Antibody (formerly LDP-02), being developed by Genentech and Millenium Pharmaceuticals, HuMax CD4, an anti-CD4 antibody being developed by Genmab, HuMax-IL15, an anti-IL15 antibody being developed by Genmab and Amgen, HuMax-Inflam, being developed by Genmab and Medarex, HuMax-Cancer, an anti-Heparanase I antibody being developed by Genmab and Medarex and Oxford GcoSciences, HuMax-Lymphoma, being developed by Genmab and Amgen, HuMax-TAC, being developed by Genmab, IDEC-131, and anti-CD40L antibody being developed by IDEC Pharmaceuticals, IDEC-151 (Clenoliximab), an anti-CD4 antibody being developed by IDEC Pharmaceuticals, IDEC-114, an anti-CD80 antibody being developed by IDEC Pharmaceuticals, IDEC-152, an anti-CD23 being developed by IDEC Pharmaceuticals, anti-macrophage migration factor (MIF) antibodies being developed by IDEC Pharmaceuticals, BEC2, an anti-idiotypic antibody being developed by Imclone, IMC-1C11, an anti-KDR antibody being developed by Imclone, DC101, an anti-flk-1 antibody being developed by Imclone, anti-VE cadherin antibodies being developed by Imclone, CEA-Cide® (labetuzumab), an anti-carcinoembryonic antigen (CEA) antibody being developed by Immunomedics, LymphoCide® (Epratuzumab), an anti-CD22 antibody being developed by Immunomedics, AFP-Cide, being developed by Immunomedics, MyelomaCide, being developed by Immunomedics, LkoCide, being developed by Immunomedics, ProstaCide, being developed by Immunomedics, MDX-010, an anti-CTLA4 antibody being developed by Medarex, MDX-060, an anti-CD30 antibody being developed by Medarex, MDX-070 being developed by Medarex, MDX-018 being developed by Medarex, Osidem® (IDM-1), and anti-Her2 antibody being developed by Medarex and Immuno-Designed Molecules, HuMax®-CD4, an anti-CD4 antibody being developed by Medarex and Genmab, HuMax-IL15, an anti-IL15 antibody being developed by Medarex and Genmab, CNTO 148, an anti-TNFα antibody being developed by Medarex and Centocor/Johnson & Johnson, CNTO 1275, an anti-cytokine antibody being developed by Centocor/Johnson & Johnson, MOR101 and MOR102, anti-intercellular adhesion molecule-1 (ICAM-1) (CD54) antibodies being developed by MorphoSys, MOR201, an anti-fibroblast growth factor receptor 3 (FGFR-3) antibody being developed by MorphoSys, Nuvion® (visilizumab), an anti-CD3 antibody being developed by Protein Design Labs, HuZAF®, an anti-gamma interferon antibody being developed by Protein Design Labs, Anti-α 501 Integrin, being developed by Protein Design Labs, anti-IL-12, being developed by Protein Design Labs, ING-1, an anti-Ep-CAM antibody being developed by Xoma, Xolair® (Omalizumab) a humanized anti-IgE antibody developed by Genentech and Novartis, and MLN01, an anti-Beta2 integrin antibody being developed by Xoma. In another embodiment, the therapeutics include KRN330 (Kirin); huA33 antibody (A33, Ludwig Institute for Cancer Research); CNTO 95 (alpha V integrins, Centocor); MEDI-522 (alpha Vf33 integrin, Medimmune); volociximab (alpha Vfβ1 integrin, Biogen/PDL); Human mAb 216 (B cell glycosolated epitope, NCI); BiTE MT103 (bispecific CD19×CD3, Medimmune); 4G7×H22 (Bispecific BcellxFcgammaR1, Medarex/Merck KGa); rM28 (Bispecific CD28×MAPG, U.S. Pat. No. EP1444268); MDX447 (EMD 82633) (Bispecific CD64×EGFR, Medarex); Catumaxomab (removab) (Bispecific EpCAM×anti-CD3, Trion/Fres); Ertumaxomab (bispecific HER2/CD3, Fresenius Biotech); oregovomab (OvaRex) (CA-125, ViRexx); Rencarex® (WX G250) (carbonic anhydrase IX, Wilex); CNTO 888 (CCL2, Centocor); TRC105 (CD105 (endoglin), Tracon); BMS-663513 (CD137 agonist, Brystol Myers Squibb); MDX-1342 (CD19, Medarex); Siplizumab (MEDI-507) (CD2, Medimmune); Ofatumumab (Humax-CD20) (CD20, Genmab); Rituximab (Rituxan) (CD20, Genentech); veltuzumab (hA20) (CD20, Immunomedics); Epratuzumab (CD22, Amgen); lumiliximab (IDEC 152) (CD23, Biogen); muromonab-CD3 (CD3, Ortho); HuM291 (CD3 fc receptor, PDL Biopharma); HeFi-1, CD30, NCl); MDX-060 (CD30, Medarex); MDX-1401 (CD30, Medarex); SGN-30 (CD30, Seattle Genentics); SGN-33 (Lintuzumab) (CD33, Seattle Genentics); Zanolimumab (HuMax-CD4) (CD4, Genmab); HCD122 (CD40, Novartis); SGN-40 (CD40, Seattle Genentics); Campathlh (Alemtuzumab) (CD52, Genzyme); MDX-1411 (CD70, Medarex); hLL1 (EPB-1) (CD74.38, Immunomedics); Galiximab (IDEC-144) (CD80, Biogen); MT293 (TRC093/D93) (cleaved collagen, Tracon); HuLuc63 (CS1, PDL Pharma); ipilimumab (MDX-010) (CTLA4, Brystol Myers Squibb); Tremelimumab (Ticilimumab, CP-675, 2) (CTLA4, Pfizer); HGS-ETR1 (Mapatumumab) (DR4TRAIL-R1 agonist, Human Genome Science/Glaxo Smith Kline); AMG-655 (DR5, Amgen); Apomab (DR5, Genentech); CS-1008 (DR5, Daiichi Sankyo); HGS-ETR2 (lexatumumab) (DR5TRAIL-R2 agonist, HGS); Cetuximab (Erbitux) (EGFR, Imclone); IMC-11F8, (EGFR, Imclone); Nimotuzumab (EGFR, YM Bio); Panitumumab (Vectabix) (EGFR, Amgen); Zalutumumab (HuMaxEGFr) (EGFR, Genmab); CDX-110 (EGFRvIII, AVANT Immunotherapeutics); adecatumumab (MT201) (Epcam™, Merck); edrecolomab (Panorex), 17-1A) (Epcam™, Glaxo/Centocor); MORAb-003 (folate receptor a, Morphotech); KW-2871 (ganglioside Kyowa); MORAb-009 (GP-9, Morphotech); CDX-1307 (MDX-1307) (hCGb, Celldex); Trastuzumab (Herceptin) (HER2, Celldex); Pertuzumab (rhuMAb 2C4) (HER2 (DI), Genentech); apolizumab (HLA-DR beta chain, PDL Pharma); AMG-479 (IGF-1R, Amgen); anti-IGF-1R R1507 (IGF1-R, Roche); CP 751871 (IGF1-R, Pfizer); IMC-A12 (IGF1-R, Imclone); BIIB022 (IGF-1R, Biogen); Mik-beta-1 (IL-2Rb (CD122), Hoffman LaRoche); CNTO 328 (IL6, Centocor); Anti-KIR (1-7F9) (Killer cell Ig-like Receptor (KIR), Novo); Hu3S193 (Lewis (y), Wyeth, Ludwig Institute of Cancer Research); hCBE-11 (LTBR, Biogen); HuH-MFG1 (MUC1, Antisoma/NCl); RAV12 (N-linked carbohydrate epitope, Raven); CAL (parathyroid hormone-related protein (PTH-rP), University of California); CT-011 (PD1, CureTech); MDX-1106 (ono-4538) (PD1, Medarex/Ono); MAb CT-011 (PD1, Curetech); IMC-3G3 (PDGFRa, Imclone); bavituximab (phosphatidylserine, Peregrine); huJ591 (PSMA, Cornell Research Foundation); muJ591 (PSMA, Cornell Research Foundation); GC1008 (TGFb (pan) inhibitor (IgG4), Genzyme); Infliximab (Remicade) (TNFa, Centocor); A27.15 (transferrin receptor, Salk Institute, INSERN WO 2005/111082); E2.3 (transferrin receptor, Salk Institute); Bevacizumab (Avastin) (VEGF, Genentech); HuMV833 (VEGF, Tsukuba Research Lab-WO/2000/034337, University of Texas); IMC-18F1 (VEGFR1, Imclone); IMC-1121 (VEGFR2, Imclone).

III.C. Construction of DVD-Binding Proteins

A multivalent multispecific dual variable domain binding protein (DVD-binding protein) is designed such that two different light chain variable domains (VL) from two different parent monoclonal antibodies are linked in tandem directly or via a short linker by recombinant DNA techniques, followed by the light chain constant domain. Similarly, the heavy chain comprises two different heavy chain variable domains (VH) linked in tandem, followed by the constant domain CH1 and Fc region.

The variable domains can be obtained using recombinant DNA techniques from a parent antibody generated by any one of the methods described herein. In an embodiment, the variable domain is a murine heavy or light chain variable domain. In another embodiment, the variable domain is a CDR-grafted or a humanized variable heavy or light chain domain. In an embodiment, the variable domain is a human heavy or light chain variable domain.

In one embodiment, the first and second variable domains are linked directly to each other using recombinant DNA techniques. In another embodiment the variable domains are linked via a linker sequence. In an embodiment, two variable domains are linked. Three or more variable domains may also be linked directly or via a linker sequence. The variable domains may bind the same antigen or may bind different antigens. DVD-binding proteins which may include one immunoglobulin variable domain and one non-immunoglobulin variable domain, such as ligand binding domain of a receptor or active domain of an enzyme, are provided. DVD-binding proteins may also comprise two or more non-Ig domains.

The linker sequence may be a single amino acid or a polypeptide sequence. In an embodiment, the linker sequences are GGGGSG (SEQ ID NO:1695), GGSGG (SEQ ID NO:1696), GGGGSGGGS (SEQ ID NO:1697), GGSGGGSGS (SEQ ID NO:1698), GGSGGGSGGGS (SEQ ID NO:1699), GGGGSGGGGSGGGG (SEQ ID NO:1700), GGGGSGGGGSGGGGS (SEQ ID NO:1701), ASTKGP (SEQ ID NO:1702), ASTKGPSVFPLAP (SEQ ID NO:1703), TVAAP (SEQ ID NO:1704), TVAAPSVFIFPP (SEQ ID NO:1705), AKTTPKLEEGEFSEAR (SEQ ID NO:1706), AKTTPKLEEGEFSEARV (SEQ ID NO:1707), AKTTPKLGG (SEQ ID NO:1710), SAKTTPKLGG (SEQ ID NO:1709), SAKTTP (SEQ ID NO:1702), RADAAP (SEQ ID NO:1711), RADAAPTVS (SEQ ID NO:1712), RADAAAAGGPGS (SEQ ID NO:1713), RADAAAAGGGGSGGGGSGGGGSGGGGS (SEQ ID NO:1714), SAKTTPKLEEGEFSEARV (SEQ ID NO:1715), ADAAP (SEQ ID NO:1716), ADAAPTVSIFPP (SEQ ID NO:2050), QPKAAP (SEQ ID NO:2051), QPKAAPSVTLFPP (SEQ ID NO:2052), AKTTPP (SEQ ID NO:2053), AKTTPPSVTPLAP (SEQ ID NO:2054), AKTTAP (SEQ ID NO:2055), AKTTAPSVYPLAP (SEQ ID NO:2056), GENKVEYAPALMALS (SEQ ID NO:2057), GPAKELTPLKEAKVS (SEQ ID NO:2058), and GHEAAAVMQVQYPAS (SEQ ID NO:2059). The choice of linker sequences is based on crystal structure analysis of several Fab molecules. There is a natural flexible linkage between the variable domain and the CH1/CL constant domain in Fab or antibody molecular structure. This natural linkage comprises approximately 10-12 amino acid residues, contributed by 4-6 residues from C-terminus of V domain and 4-6 residues from the N-terminus of CL/CH1 domain. DVD-binding proteins described herein can be generated using N-terminal 5-6 amino acid residues, or 11-12 amino acid residues, of CL or CH1 as linker in light chain and heavy chain of DVD-binding protein, respectively. The N-terminal residues of CL or CH1 domains, particularly the first 5-6 amino acid residues, adopt a loop conformation without strong secondary structures, and therefore can act as flexible linkers between the two variable domains. The N-terminal residues of CL or CH1 domains are natural extension of the variable domains, as they are part of the Ig sequences, and therefore minimize to a large extent any immunogenicity potentially arising from the linkers and junctions.

Other linker sequences may include any sequence of any length of CL/CH1 domain but not all residues of CL/CH1 domain; for example the first 5-12 amino acid residues of the CL/CH1 domains; the light chain linkers can be from Cκ or Cλ; and the heavy chain linkers can be derived from CH1 of any isotypes, including Cγ1, Cγ2, Cγ3, Cγ4, Cα1, Cα2, Cδ, Cε, and Cμ. Linker sequences may also be derived from other proteins such as Ig-like proteins, (e.g., TCR, FcR, KIR); G/S based sequences; hinge region-derived sequences; and other natural sequences from other proteins.

In an embodiment a constant domain is linked to the two linked variable domains using recombinant DNA techniques. In an embodiment, a sequence comprising tandemly linked heavy chain variable domains is linked to a heavy chain constant domain and a sequence comprising tandemly linked light chain variable domains is linked to a light chain constant domain. In an embodiment, the constant domains are human heavy chain constant domain and human light chain constant domain, respectively. In an embodiment, the DVD heavy chain is further linked to an Fc region. The Fc region may be a native sequence Fc region, or a variant Fc region. In another embodiment, the Fc region is a human Fc region. In another embodiment the Fc region includes Fc region from IgG1, IgG2, IgG3, IgG4, IgA, IgM, IgE, or IgD.

In an embodiment, two heavy chain DVD polypeptides and two light chain DVD polypeptides are combined to form a DVD-binding protein. Detailed description of specific DVD-binding proteins capable of binding specific target antigens, such as SOST, and methods of making the same are provided in the Examples section below.

III.D. Production of DVD-Binding Proteins

DVD-binding proteins produced by any of a number of techniques known in the art are provided, including for example, expression from host cells, wherein expression vector(s) encoding the DVD-binding protein heavy and DVD-binding protein light chains is (are) transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection and the like. Although it is possible to express the provided DVD-binding proteins in either prokaryotic or eukaryotic host cells, DVD-binding proteins are expressed in eukaryotic cells, for example, mammalian host cells, because such eukaryotic cells (and in particular mammalian cells) are more likely than prokaryotic cells to assemble and secrete a properly folded and immunologically active DVD-binding protein.

Exemplary mammalian host cells for expressing the provided recombinant antibodies include Chinese Hamster Ovary (CHO cells) (including dhfr-CHO cells, described in Urlaub and Chasin, (1980) Proc. Natl. Acad. Sci. USA, 77: 4216-4220, used with a DHFR selectable marker, e.g., as described in R. J. Kaufman and P.A. Sharp (1982) Mol. Biol., 159: 601-621), NS0 myeloma cells, COS cells, SP2 and PER.C6 cells. When recombinant expression vectors encoding DVD-binding proteins are introduced into mammalian host cells, the DVD-binding proteins are produced by culturing the host cells for a period of time sufficient to allow for expression of the DVD-binding proteins in the host cells or secretion of the DVD proteins into the culture medium in which the host cells are grown. DVD-binding proteins can be recovered from the culture medium using standard protein purification methods.

In an exemplary system for recombinant expression of the provided DVD-binding proteins, a recombinant expression vector encoding both the DVD-binding protein heavy chain and the DVD-binding protein light chain is introduced into dhfr-CHO cells by calcium phosphate-mediated transfection. Within the recombinant expression vector, the DVD-binding protein heavy and light chain genes are each operatively linked to CMV enhancer/AdMLP promoter regulatory elements to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the DVD-binding protein heavy and light chains and intact DVD-binding protein is recovered from the culture medium. Standard molecular biology techniques are used to prepare the recombinant expression vector, transfect the host cells, select for transformants, culture the host cells and recover the DVD-binding protein from the culture medium. Still further, a method is provided of synthesizing a DVD-binding protein by culturing a host cell in a suitable culture medium until a DVD-binding protein is synthesized. The method can further comprise isolating the DVD-binding protein from the culture medium.

An important feature of DVD-binding protein is that it can be produced and purified in a similar way as a conventional antibody. The production of DVD-binding protein results in a homogeneous, single major product with desired dual-specific activity, without any sequence modification of the constant region or chemical modifications of any kind. Other previously described methods to generate "bi-specific", "multi-specific", and "multi-specific multivalent" full length binding proteins do not lead to a single primary product but instead lead to the intracellular or secreted production of a mixture of assembled inactive, mono-specific, multi-specific, multivalent, full length binding proteins, and multivalent full length binding proteins with combination of different binding sites. As an example, based on the design described by Miller and Presta (PCT Publication No. WO 2001/077342(A1), there are 16 possible combinations of heavy and light chains. Consequently only 6.25% of protein is likely to be in the desired active form, and not as a single major product or single primary product compared to the other 15 possible combinations. Separation of the desired, fully active forms of the protein from inactive and partially active forms of the protein using standard chromatography techniques, typically used in large scale manufacturing, is yet to be demonstrated.

Surprisingly, the provided design of the "dual-specific multivalent full length binding proteins" of the leads to a dual variable domain light chain and a dual variable domain heavy chain which assemble primarily to the desired "dual-specific multivalent full length binding proteins".

At least 50%, at least 75%, and at least 90% of the assembled, and expressed DVD-binding proteins are the desired dual-specific tetravalent protein. This aspect particularly enhances the commercial utility of the invention provided. Therefore, a method to express a dual variable domain light chain and a dual variable domain heavy chain in a single cell leading to a single primary product of a "dual-specific tetravalent full length binding protein" is provided.

Methods of expressing a dual variable domain light chain and a dual variable domain heavy chain in a single cell leading to a "primary product" of a "dual-specific, tetravalent, full length binding protein", where the "primary product" is more than 50% of all assembled protein, comprising a dual variable domain light chain and a dual variable domain heavy chain are provided.

Methods of expressing a dual variable domain light chain and a dual variable domain heavy chain in a single cell leading to a single "primary product" of a "dual-specific, tetravalent, full length binding protein", where the "primary product" is more than 75% of all assembled protein, comprising a dual variable domain light chain and a dual variable domain heavy chain are provided.

Methods of expressing a dual variable domain light chain and a dual variable domain heavy chain in a single cell leading to a single "primary product" of a "dual-specific tetravalent full length binding protein", where the "primary product" is more than 90% of all assembled protein, comprising a dual variable domain light chain and a dual variable domain heavy chain are provided.

IV. Production of Sclerostin Binding Proteins and Binding Protein-Producing Cell Lines In a provided embodiment, sclerostin binding proteins, including anti-sclerostin antibodies, exhibit a high capacity to reduce or to neutralize SOST activity, e.g., as assessed by any one of several in vitro and in vivo assays known in the art. Preferably, sclerostin binding proteins also exhibit a high capacity to reduce or to neutralize SOST activity In embodiments, a binding protein, or antigen-binding portion thereof, binds human sclerostin, wherein the binding protein, or antigen-binding portion thereof, dissociates from human SOST with a $k_{off}$ rate constant of about $0.1s^{-1}$ or less, as determined by surface plasmon resonance, or which inhibits human SOST activity with an $IC_{50}$ of about $1\times10^{-6}$M or less. Alternatively, the binding protein, or an antigen-binding portion thereof, may dissociate from human sclerostin with a $k_{off}$ rate constant of about $1\times10^{-2}s^{-1}$ or less, as determined by surface plasmon resonance, or may inhibit human sclerostin activity with an $IC_{50}$ of about $1\times10^{-7}$M or less. Alternatively, the binding protein, or an antigen-binding portion thereof, may dissociate from human sclerostin with a $k_{off}$ rate constant of about $1\times10^{-3}s^{-1}$ or less, as determined by surface plasmon resonance, or may inhibit human sclerostin with an $IC_{50}$ of about $1\times10^{-8}$M or less. Alternatively, the binding protein, or an antigen-binding portion thereof, may dissociate from human sclerostin with a $k_{off}$ rate constant of about $1\times10^{-4}s^{-1}$ or less, as determined by surface plasmon resonance, or may inhibit human sclerostin activity with an $IC_{50}$ of about $1\times10^{-9}$M or less. Alternatively, the binding protein, or an antigen-binding portion thereof, may dissociate from human sclerostin with a $k_{off}$ rate constant of about $1\times10^{-5}s^{-1}$ or less, as determined by surface plasmon resonance, or may inhibit human sclerostin activity with an $IC_{50}$ of about $1\times10^{-10}$ M or less. Alternatively, the binding protein, or an antigen-binding portion thereof, may dissociate from human sclerostin with a $k_{off}$ rate constant of about $1\times10^{-5}s^{-1}$ or less, as determined by surface plasmon resonance, or may inhibit human sclerostin activity with an $IC_{50}$ of about $1\times10^{-11}$ M or less.

In certain embodiments, the binding protein comprises a heavy chain constant region, such as an IgG1, IgG2, IgG3, IgG4, IgA, IgE, IgM or IgD constant region. In an embodiment, the heavy chain constant region is an IgG1 heavy chain constant region or an IgG4 heavy chain constant region. Furthermore, the antibody can comprise a light chain constant region, either a kappa light chain constant region or a lambda light chain constant region. In an embodiment, the antibody comprises a kappa light chain constant region. Alternatively, the antibody portion can be, for example, a Fab fragment or a single chain Fv fragment.

Replacements of amino acid residues in the Fc portion to alter antibody effector function are known in the art (Winter et al., U.S. Pat. Nos. 5,648,260 and 5,624,821). The Fc portion of an antibody mediates several important effector functions e.g. cytokine induction, ADCC, phagocytosis, complement dependent cytotoxicity (CDC) and half-life/clearance rate of antibody and antigen-antibody complexes. In some cases these effector functions are desirable for therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies. In still another embodiment at least one amino acid residue is replaced in the constant region of the antibody, for example the Fc region of the antibody, such that effector functions of the antibody are altered.

One embodiment provides a labeled binding protein wherein an antibody or antibody portion is derivatized or linked to another functional molecule (e.g., another peptide or protein). For example, a labeled binding protein can be derived by functionally linking an antibody or antibody portion (by chemical coupling, genetic fusion, noncovalent association or otherwise) to one or more other molecular entities, such as another antibody (e.g., a bispecific antibody or a diabody), a detectable agent, a cytotoxic agent, a pharmaceutical agent, and/or a protein or peptide that can mediate associate of the antibody or antibody portion with another molecule (such as a streptavidin core region or a polyhistidine tag).

Useful detectable agents are provided with which a binding protein, such as an antibody or antibody portion of the may be derivatized include fluorescent compounds. Exemplary fluorescent detectable agents include fluorescein, fluorescein isothiocyanate, rhodamine, 5-dimethylamine-1-napthalene-sulfonyl chloride, phycoerythrin and the like. An antibody may also be derivatized with detectable enzymes, such as alkaline phosphatase, horseradish peroxidase, glucose oxidase and the like. When an antibody is derivatized with a detectable enzyme, it is detected by adding additional reagents that the enzyme uses to produce a detectable reaction product. For example, when the detectable agent horseradish peroxidase is present, the addition of hydrogen peroxide and diaminobenzidine leads to a colored reaction product, which is detectable. An antibody may also be derivatized with biotin, and detected through indirect measurement of avidin or streptavidin binding.

Another embodiment provides a crystallized binding protein. In an embodiment, crystals of whole anti-sclerostin antibodies and fragments thereof as disclosed herein, and formulations and compositions comprising such crystals are provided. In one embodiment the crystallized binding protein has a greater half-life in vivo than the soluble counterpart of the binding protein. In another embodiment the binding protein retains biological activity after crystallization.

Crystallized binding protein are provided and may be produced according methods known in the art and as disclosed in PCT Publication No. WO 02072636.

Another embodiment provides a glycosylated binding protein wherein the antibody or antigen-binding portion thereof comprises one or more carbohydrate residues. Nascent in vivo protein production may undergo further processing, known as post-translational modification. In particular, sugar (glycosyl) residues may be added enzymatically, a process known as glycosylation. The resulting proteins bearing covalently linked oligosaccharide side chains are known as glycosylated proteins or glycoproteins.

Naturally occurring antibodies are glycoproteins with one or more carbohydrate residues in the Fc domain, as well as the variable domain. Carbohydrate residues in the Fc domain have important effect on the effector function of the Fc domain, with minimal effect on antigen binding or half-life of the antibody (R. Jefferis, *Biotechnol.Prog.*, 21: 11-16 (2005)). In contrast, glycosylation of the variable domain may have an effect on the antigen binding activity of the antibody. Glycosylation in the variable domain may have a negative effect on antibody binding affinity, likely due to steric hindrance (Co, M. S., et al., *Mol. Immunol.*, 30: 1361-1367 (1993)), or result in increased affinity for the antigen (Wallick, S. C., et al., *Exp. Med.*, 168:1099-1109 (1988); Wright, A., et al., *EMBO J.*, 10: 2717-2723 (1991)).

One aspect of the provided is directed to generating glycosylation site mutants in which the O- or N-linked glycosylation site of the binding protein has been mutated. One skilled in the art can generate such mutants using standard well-known technologies. Glycosylation site mutants that retain the biological activity but have increased or decreased binding activity are provided.

In still another provided embodiment, the glycosylation of the antibody or antigen-binding portion is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region glycosylation sites to thereby eliminate glycosylation at that site. Such aglycosylation may increase the affinity of the antibody for antigen. Such an approach is described in further detail in PCT Publication WO 2003/016466A2, and U.S. Pat. Nos. 5,714,350 and 6,350,861.

Additionally or alternatively, a modified binding protein is provided and can be made to have an altered type of glycosylation, such as a hypofucosylated antibody having reduced amounts of fucosyl residues (see Kanda, Yutaka et al., Journal of Biotechnology (2007), 130(3), 300-310.) or an antibody having increased bisecting GlcNAc structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery are provided and have been described in the art and can be used as host cells in which to express recombinant antibodies to thereby produce an antibody with altered glycosylation. See, for example, Shields, R. L. et al. (2002) J. Biol. Chem. 277:26733-26740; Umana et al., "Engineered glycoforms of an antineuroblastoma IgG1 with optimized antibody-dependent cellular cytotoxic activity," *Nat. Biotech.*, 17: 176-180 (1999), as well as, European Patent No: EP 1,176,195; PCT Publication Nos. WO 03/035835 and WO 99/54342.

Protein glycosylation depends on the amino acid sequence of the protein of interest, as well as the host cell in which the protein is expressed. Different organisms may produce different glycosylation enzymes (e.g., glycosyltransferases and glycosidases), and have different substrates (nucleotide sugars) available. Due to such factors, protein glycosylation pattern, and composition of glycosyl residues, may differ depending on the host system in which the particular protein is expressed. Useful Glycosyl residues are provided and may include, but are not limited to, glucose, galactose, mannose, fucose, n-acetylglucosamine and sialic acid. In an embodiment, the glycosylated binding protein comprises glycosyl residues such that the glycosylation pattern is human.

It is known to those skilled in the art that differing protein glycosylation may result in differing protein characteristics. For instance, the efficacy of a therapeutic protein produced in a microorganism host, such as yeast, and glycosylated utilizing the yeast endogenous pathway may be reduced compared to that of the same protein expressed in a mammalian cell, such as a CHO cell line. Such glycoproteins may also be immunogenic in humans and show reduced half-life in vivo after administration. Specific receptors in humans and other animals may recognize specific glycosyl residues and promote the rapid clearance of the protein from the bloodstream. Other adverse effects may include changes in protein folding, solubility, susceptibility to proteases, trafficking, transport, compartmentalization, secretion, recognition by other proteins or factors, antigenicity, or allergenicity. Accordingly, a practitioner may prefer a therapeutic protein with a specific composition and pattern of glycosylation, for example glycosylation composition and pattern identical, or at least similar, to that produced in human cells or in the species-specific cells of the intended subject animal.

Expressing glycosylated proteins different from that of a host cell may be achieved by genetically modifying the host cell to express heterologous glycosylation enzymes. Using techniques known in the art a practitioner may generate antibodies or antigen-binding portions thereof exhibiting human protein glycosylation. For example, yeast strains have been genetically modified to express non-naturally occurring glycosylation enzymes such that glycosylated proteins (glycoproteins) produced in these yeast strains exhibit protein glycosylation identical to that of animal cells, especially human cells (US patent application publication Nos. 20040018590 and 20020137134).

In addition to the binding proteins, anti-idiotypic (anti-Id) antibodies specific for such binding proteins are provided. An anti-Id antibody is an antibody, which recognizes unique determinants generally associated with the antigen-binding region of another antibody. The anti-Id can be prepared by immunizing an animal with the binding protein or a CDR containing region thereof. The immunized animal will recognize, and respond to the idiotypic determinants of the immunizing antibody and produce an anti-Id antibody. It is readily apparent that it may be easier to generate anti-idiotypic antibodies to the two or more parent antibodies incorporated into a DVD-binding protein molecule; and confirm binding studies by methods well recognized in the art (e.g., BIAcore, ELISA) to verify that anti-idiotypic antibodies specific for the idiotype of each parent antibody also recognize the idiotype (e.g., antigen binding site) in the context of the DVD-binding protein. The anti-idiotypic antibodies specific for each of the two or more antigen binding sites of a DVD-binding protein provide ideal reagents to measure DVD-binding protein concentrations of a human DVD-binding protein in patient serum. For example, DVD-binding protein concentration assays can be established using a "sandwich assay ELISA format" with an antibody to a first antigen binding region coated on the solid phase (e.g., BIAcore chip, ELISA plate, etc.), rinsed with rinsing buffer, incubation with a serum sample, another rinsing step, and ultimately incubation with another anti-idiotypic antibody to the other antigen binding site, itself labeled with an enzyme for quantitation of the binding reaction. In an embodiment, for a DVD-binding protein with more than two different binding sites, anti-idiotypic antibodies to the two outermost binding sites (most distal and proximal from the constant region) will not only help in determining the DVD-binding protein concentration in human serum but also document the integrity of the molecule in vivo. Each anti-Id antibody may also be used as an "immunogen" to induce an immune response in yet another animal, producing a so-called anti-anti-Id antibody.

Further, it will be appreciated by one skilled in the art that a protein of interest may be expressed using a library of host cells genetically engineered to express various glycosylation enzymes, such that member host cells of the library produce the protein of interest with variant glycosylation patterns. A practitioner may then select and isolate the protein of interest with particular novel glycosylation patterns. In an embodiment, the protein having a particularly selected novel glycosylation pattern exhibits improved or altered biological properties.

V. Uses of Sclerostin Binding Proteins

Given their ability to bind to human sclerostin, the sclerostin binding proteins, or antigen binding portions thereof, are provided and can be used to detect sclerostin (e.g., in a biological sample, such as serum or plasma), using a conventional immunoassay, such as an enzyme linked immunosorbent assays (ELISA), an radioimmunoassay (RIA) or tissue immunohistochemistry. A method for detecting sclerostin in a biological sample is provided comprising contacting a biological sample with a provided binding protein, or antigen binding portion, and detecting either the binding protein (or antigen binding portion) bound to sclerostin or unbound binding protein (or binding portion), to thereby detect sclerostin in the biological sample. The binding protein is directly or indirectly labeled with a detectable substance to facilitate detection of the bound or unbound antibody. Suitable detectable substances include various enzymes, prosthetic groups, fluorescent materials, luminescent materials and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; and examples of suitable radioactive material include $^{3}$H, $^{14}$C, $^{35}$S, $^{90}$Y, $^{99}$Tc, $^{111}$In, $^{125}$I, $^{131}$I, $^{177}$Lu, $^{166}$Ho, or $^{153}$Sm.

Alternative to labeling the binding protein, human sclerostin can be assayed in biological fluids by a competition immunoassay utilizing rhSOST standards labeled with a detectable substance and an unlabeled human sclerostin binding protein. In this assay, the biological sample, the labeled rhSOST standards, and the human sclerostin binding protein are combined and the amount of labeled recombinant human sclerostin standard bound to the unlabeled antibody is determined The amount of human sclerostin in the biological sample is inversely proportional to the amount of labeled rhSOST standard bound to the sclerostin binding protein. Similarly, human sclerostin can also be assayed in biological fluids by a competition immunoassay utilizing rhSOST standards labeled with a detectable substance and an unlabeled human sclerostin binding protein.

In a provided embodiment, the binding proteins and sclerostin binding portions of are capable of neutralizing human sclerostin activity both in vitro and in vivo. Accordingly, such binding proteins and sclerostin binding portions thereof are provided and can be used to inhibit hSOST activity, e.g., in a cell culture containing hSOST, in human subjects, or in other mammalian subjects having sclerostin with which an antibody cross-reacts. One embodiment provides a method for inhibiting hSOST activity comprising contacting hSOST with a sclerostin binding protein or binding portion thereof such that hSOST activity is inhibited. For example, in a cell culture containing, or suspected of containing hSOST, a sclerostin binding protein or binding portion thereof can be added to the culture medium to inhibit hSOST activity in the culture.

Another embodiment provides a method for reducing hSOST activity in a subject, advantageously from a subject suffering from a disease or disorder in which sclerostin activity is detrimental. Methods for reducing sclerostin activity in a subject suffering from such a disease or disorder are provided, which method comprises administering to the subject an antibody or antibody portion such that sclerostin activity in the subject is reduced. In an embodiment, the sclerostin is human sclerostin and the subject is a human subject. Alternatively, the subject can be a mammal expressing an sclerostin to which an antibody is capable of binding. Still further, the subject can be a mammal into which sclerostin has been introduced (e.g., by administration of sclerostin or by expression of an SOST transgene). A sclerostin binding protein can be administered to a human subject for therapeutic purposes. Moreover, a binding protein can be administered to a non-human mammal expressing an sclerostin with which the antibody is capable of binding for veterinary purposes or as an animal model of human disease. Regarding the latter, such animal models may be useful for evaluating the therapeutic efficacy of antibodies (e.g., testing of dosages and time courses of administration).

The term "a disorder in which sclerostin activity is detrimental" is intended to include diseases and other disorders in which the presence of sclerostin in a subject suffering from the disorder has been shown to be or is suspected of being either responsible for the pathophysiology of the disorder or a factor that contributes to a worsening of the disorder. Accordingly, a disorder in which sclerostin activity is detrimental is a disorder in which reduction of sclerostin activity is expected to alleviate the symptoms and/or progression of the disorder. Such disorders may be evidenced, for example, by an increase in the concentration of sclerostin in a biological fluid of a subject suffering from the disorder (e.g., an increase in the concentration of sclerostin in serum, plasma, synovial fluid, etc. of the subject), which can be detected, for example, using an anti-sclerostin antibody as described above. Non-limiting examples of disorders that can be treated with the antibodies include those disorders discussed in the section below pertaining to pharmaceutical compositions of the antibodies.

DVD-binding proteins capable of binding sclerostin (e.g., human sclerostin) alone or multiple antigens (e.g., human sclerostin and another non-sclerostin antigen) are provided. Thus, a DVD-binding protein may block or reduce activity of human sclerostin and the activity of another target antigen. Such other target antigens may include soluble targets (e.g., TNF) and cell surface receptor targets (e.g., VEGFR, EGFR).

Such other antigens include, but are not limited to, the targets listed in publically available databases, which databases include those that are available on the worldwide web. These target databases include those listing:

Therapeutic targets (hxin.cz3.nus.edu.sg/group/cjttd/tt-d.asp);
Cytokines and cytokine receptors (hwww.cytokineweb-facts.com/, hwww.copewithcytokines.de/cope.cgi, and hcmbi.bjmu.edu.cn/cmbidata/cgf/CGF_Database/cytokine.medic.kumamoto-u.ac.jp/CFC/indexR.html);
Chemokines (hcytokine.medic.kumamoto-u.ac.jp/CFC/CK/Chemokine.html);
Chemokine receptors and GPCRs (hcsp.medic.kumamoto-u.ac.jp/CSP/Receptor.html, hwww.gper.org/7tm/);
Olfactory Receptors (hsenselab.med.yale.edu/senselab/ORDB/defaultasp);
Receptors (hwww.iuphar-db.org/iuphar-rd/list/index.htm);
Cancer targets (hcged.hgc.jp/cgi-bin/input.cgi);
Secreted proteins as potential antibody targets (hspd.cbi.pku.edu.cn/);
Protein kinases (hspd.cbi.pku.edu.cn/), and
Human CD markers (hcontent.labvelocity.com/tools/6/1226/CD_table_final_locked.pdf) and (Zola H, 2005 CD molecules 2005: human cell differentiation molecules Blood, 106:3123-6).

DVD-binding proteins are useful as therapeutic agents to simultaneously block two or more different targets, i.e., hSOST, and one or more other non-SOST target antigens to enhance efficacy/safety and/or increase patient coverage. Such targets may include soluble targets (TNF) and cell surface receptor targets (VEGFR and EGFR).

Additionally, DVD-binding proteins that can be employed for tissue-specific delivery (target a tissue marker and a disease mediator for enhanced local PK thus higher efficacy and/or lower toxicity) are provided, including intracellular delivery (targeting an internalizing receptor and a intracellular molecule), delivering to inside brain (targeting transferrin receptor and a CNS disease mediator for crossing the blood-brain barrier). DVD-binding protein can also serve as a carrier protein to deliver an antigen to a specific location via binding to a non-neutralizing epitope of that antigen and also to increase the half-life of the antigen. Furthermore, DVD-binding protein can be designed to either be physically linked to medical devices implanted into patients or target these medical devices (see Burke, Sandra E.; Kuntz, Richard E.; Schwartz, Lewis B., Zotarolimus eluting stents. Advanced Drug Delivery Reviews (2006), 58(3), 437-446; Surface coatings for biological activation and functionalization of medical devices, Hildebrand, H. F.; Blanchemain, N.; Mayer, G.; Chai, F.; Lefebvre, M.; Boschin, F., Surface and Coatings Technology (2006), 200(22-23), 6318-6324; Wu et al., "Drug/device combinations for local drug therapies and infection prophylaxis," *Biomaterials*, 27: 2450-2467 (2006); Marques et al., "Mediation of the Cytokine Network in the Implantation of Orthopedic Devices," Chapter 21, In *Biodegradable Systems in Tissue Engineering and Regenerative Medicine*, (Reis et al., eds.) (CRC Press LLC, Boca Raton, 2005) pp. 377-397. Briefly, directing appropriate types of cell to the site of medical implant may promote healing and restoring normal tissue function. Alternatively, inhibition of mediators (including but not limited to cytokines), released upon device implantation by a DVD-binding protein coupled to or target to a device is also provided. For example, Stents have been used for years in interventional cardiology to clear blocked arteries and to improve the flow of blood to the heart muscle. However, traditional bare metal stents have been known to cause restenosis (re-narrowing of the artery in a treated area) in some patients and can lead to blood clots. Recently, an anti-CD34 antibody coated stent has been described which reduced restenosis and prevents blood clots from occurring by capturing endothelial progenitor cells (EPC) circulating throughout the blood. Endothelial cells are cells that line blood vessels, allowing blood to flow smoothly. The EPCs adhere to the hard surface of the stent forming a smooth layer that not only promotes healing but prevents restenosis and blood clots, complications previously associated with the use of stents (Aoji et al. 2005 J Am Coll Cardiol. 45(10):1574-9). In addition to improving outcomes for patients requiring stents, there are also implications for patients requiring cardiovascular bypass surgery. For example, a prosthetic vascular conduit (artificial artery) coated with anti-EPC antibodies would eliminate the need to use arteries from patients legs or arms for bypass surgery grafts. This would reduce surgery and anesthesia times, which in turn will reduce coronary surgery deaths. DVD-binding protein are designed in such a way that it binds to a cell surface marker (such as CD34) as well as a protein (or an epitope of any kind, including but not limited to proteins, lipids and polysaccharides) that has been coated on the implanted device to facilitate the cell recruitment. Such approaches can also be applied to other medical implants in general. Alternatively, DVD-binding proteins can be coated on medical devices and upon implantation and releasing all DVDs from the device (or any other need which may require additional fresh DVD-binding protein, including aging and denaturation of the already loaded DVD-binding protein) the device could be reloaded by systemic administration of fresh DVD-binding protein to the patient, where the DVD-binding protein is designed to binds to a target of interest (a cytokine, a cell surface marker (such as CD34) etc.) with one set of binding sites and to a target coated on the device (including a protein, an epitope of any kind, including but not limited to lipids, polysaccharides and polymers) with the other. This technology has the advantage of extending the usefulness of coated implants.

V.A. Use of DVD-Binding Proteins in Various Diseases

DVD-binding proteins useful as therapeutic molecules to treat various diseases are provided. Such DVD molecules may bind one or more targets involved in a specific disease. Examples of such targets in various diseases are described below.

VI. Human Autoimmune and Inflammatory Response

In one aspect, a DVD-binding protein capable of binding human sclerostin and one or more antigens that have been implicated in general autoimmune and inflammatory responses is provided, including C5, CCL1 (1-309), CCL11 (eotaxin), CCL13 (mcp-4), CCL15 (MIP-1d), CCL16 (HCC-4), CCL17 (TARC), CCL18 (PARC), CCL19, CCL2 (mcp- 1), CCL20 (MIP-3a), CCL21 (MIP-2), CCL23 (MPIF-1), CCL24 (MPIF-2/eotaxin-2), CCL25 (TECK), CCL26, CCL3 (MIP-1a), CCL4 (MIP-1b), CCL5 (RANTES), CCL7 (mcp-3), CCL8 (mcp-2), CXCL1, CXCL10 (IP-10), CXCL11 (1-TAC/IP-9), CXCL12 (SDF1), CXCL13, CXCL14, CXCL2, CXCL3, CXCL5 (ENA-78/LIX), CXCL6 (GCP-2), CXCL9, IL13, IL8, CCL13 (mcp-4), CCR1, CCR2, CCR3, CCR4, CCR5, CCR6, CCR7, CCR8, CCR9, CX3CR1, IL8RA, XCR1 (CCXCR1), IFNA2, IL10, IL13, IL17C, IL1A, IL1B, IL1F10, IL1F5, IL1F6, IL1F7, IL1F8, IL1F9, IL22, IL5, IL8, IL9, LTA, LTB, MIF, SCYE1 (endothelial Monocyte-activating cytokine), SPP1, TNF, TNFSF5, IFNA2, IL10RA, IL10RB, IL13, IL13RA1, IL5RA, IL9, IL9R, ABCF1, BCL6, C3, C4A, CEBPB, CRP, ICEBERG, IL1R1, IL1RN, IL8RB, LTB4R, TOLLIP, FADD, IRAK1, IRAK2, MYD88, NCK2, TNFAIP3, TRADD, TRAF1, TRAF2, TRAF3, TRAF4, TRAF5, TRAF6, ACVR1, ACVR1B, ACVR2, ACVR2B, ACVRL1, CD28, CD3E, CD3G, CD3Z, CD69, CD80, CD86, CNR1, CTLA4, CYSLTR1, FCER1A, FCER2, FCGR3A, GPR44, HAVCR2, OPRD1, P2RX7, TLR2, TLR3, TLR4, TLR5, TLR6, TLR7, TLR8, TLR9, TLR10, BLR1, CCL1, CCL2, CCL3, CCL4, CCL5, CCL7, CCL8, CCL11, CCL13, CCL15, CCL16, CCL17, CCL18, CCL19, CCL20, CCL21, CCL22, CCL23, CCL24, CCL25, CCR1, CCR2, CCR3, CCR4, CCR5, CCR6, CCR7, CCR8, CCR9, CX3CL1, CX3CR1, CXCL1, CXCL2, CXCL3, CXCL5, CXCL6, CXCL10, CXCL11, CXCL12, CXCL13, CXCR4, GPR2, SCYE1, SDF2, XCL1, XCL2, XCR1, AMH, AMHR2, BMPR1A, BMPR1B, BMPR2, C19orf10 (IL27w), CER1, CSF1, CSF2, CSF3, DKFZp451J0118, FGF2, GF11, IFNA1, IFNB1, IFNG, IGF1, IL1A, IL1B, IL1R1, IL1R2, IL2, IL2RA, IL2RB, IL2RG, IL3, IL4, IL4R, IL5, IL5RA, IL6, IL6R, IL6ST, IL7, IL8, IL8RA, IL8RB, IL9, IL9R, IL10, IL10RA, IL10RB, IL11, IL11RA, IL12A, IL12B, IL12RB1, IL12RB2, IL13, IL13RA1, IL13RA2, IL15, IL15RA, IL16, IL17, IL17R, IL18, IL18R1, IL19, IL20, KITLG, LEP, LTA, LTB, LTB4R, LTB4R2, LTBR, MIF, NPPB, PDGFB, TBX21, TDGF1, TGFA, TGFB1, TGFB111, TGFB2, TGFB3, TGFBI, TGFBR1, TGFBR2, TGFBR3, TH1L, TNF, TNFRSF1A, TNFRSF1B, TNFRSF7, TNFRSF8, TNFRSF9, TNFRSF11A, TNFRSF21, TNFSF4, TNFSF5, TNFSF6, TNFSF11, VEGF, ZFPM2, and RNF110 (ZNF144).

VI.A. Asthma

Allergic asthma is characterized by the presence of eosinophilia, goblet cell metaplasia, epithelial cell alterations, airway hyperreactivity (AHR), and Th2 and Th1 cytokine expression, as well as elevated serum IgE levels. It is now widely accepted that airway inflammation is the key factor underlying the pathogenesis of asthma, involving a complex interplay of inflammatory cells such as T cells, B cells, eosinophils, mast cells and macrophages, and of their secreted mediators including cytokines and chemokines. Corticosteroids are the most important anti-inflammatory treatment for asthma today, however their mechanism of action is non-specific and safety concerns exist, especially in the juvenile patient population. The development of more specific and targeted therapies is therefore warranted.

Animal models such as OVA-induced asthma mouse model, where both inflammation and AHR can be assessed, are known in the art and may be used to determine the ability of various DVD-binding proteins to treat asthma Animal models for studying asthma are disclosed in Coffman, et al., Journal of Experimental Medicine (2005), 201(12), 1875-1879; Lloyd, et al., Advances in Immunology (2001), 77, 263-295; Boyce et al., Journal of Experimental Medicine (2005), 201(12), 1869-1873; and Snibson, et al., Journal of the British Society for Allergy and Clinical Immunology (2005), 35(2), 146-52. In addition to routine safety assessments of these target pairs specific tests for the degree of immunosuppression may be warranted and helpful in selecting the best target pairs (see Luster et al., Toxicology (1994), 92(1-3), 229-43; Descotes, et al., Developments in biological standardization (1992), 77 99-102; Hart et al., Journal of Allergy and Clinical Immunology (2001), 108(2), 250-257).

One aspect provides DVD-binding proteins capable of binding SOST and one or more, for example two, of IL-4, IL-5, IL-8, IL-9, IL-13, IL-18, IL-5R($\alpha$), TNFSF4, IL-4R($\alpha$), interferon $\alpha$, eotaxin, TSLP, PAR-2, PGD2, or IgE. An embodiment includes a dual-specific anti-sclerostin/TNF$\alpha$ DVD-binding protein as a therapeutic agent beneficial for the treatment of asthma.

VI.B. Rheumatoid Arthritis (RA)

Rheumatoid arthritis (RA), a systemic disease, is characterized by a chronic inflammatory reaction in the synovium of joints and is associated with degeneration of cartilage and erosion of juxta-articular bone. Many pro-inflammatory cytokines including TNF, chemokines, and growth factors are expressed in diseased joints. Systemic administration of anti-TNF antibody or sTNFR fusion protein to mouse models of RA was shown to be anti-inflammatory and joint protective. Various cytokines, included sclerostin have been implicated in RA. Clinical investigations in which the activity of TNF in RA patients was blocked with intravenously administered infliximab (Harriman G, Harper L K, Schaible T F. 1999 Summary of clinical trials in rheumatoid arthritis using infliximab, an anti-TNFalpha treatment. Ann. Rheum. Dis., 58 Suppl 1: I61-4), a chimeric anti-TNF mAb, has provided evidence that TNF regulates IL-6, IL-8, MCP-1, and VEGF production, recruitment of immune and inflammatory cells into joints, angiogenesis, and reduction of blood levels of matrix metalloproteinases-1 and -3. A better understanding of the inflammatory pathway in rheumatoid arthritis has led to identification of other therapeutic targets involved in rheumatoid arthritis. Promising treatments such as interleukin-6 antagonists (IL-6 receptor antibody MRA, developed by Chugai, Roche (see Nishimoto, Norihiro et al., *Arthritis & Rheumatism*, (2004), 50(6): 1761-1769), CTLA4Ig (abatacept, Genovese et al. (2005) "Abatacept for rheumatoid arthritis refractory to tumor necrosis factor alpha inhibition," *N. Engl. J. Med.*, 353: 1114-23.), and anti-B cell therapy (rituximab, Okamoto H, Kamatani N. (2004) "Rituximab for rheumatoid arthritis," *N. Engl. J. Med.*, 351: 1909) have already been tested in randomized controlled trials over the past year. Sclerostin and other cytokines, such as IL-15 and IL-18, have been identified as playing a role using RA animal models (therapeutic antibody HuMax-IL_15, AMG 714 see Baslund, Bo et al., Arthritis & Rheumatism (2005), 52(9): 2686-2692). Dual-specific antibody therapy, combining anti-TNF and another mediator, such as sclerostin, has great potential in enhancing clinical efficacy and/or patient coverage. For example, blocking both TNF and VEGF can potentially eradicate inflammation and angiogenesis, both of which are involved in pathophysiology of RA. A DVD-binding protein capable of blocking TNF-$\alpha$ and sclerostin is contemplated. In addition to routine safety assessments of these target pairs, specific tests for the degree of immunosuppression may be warranted and helpful in selecting the best target pairs (see Luster et al., Toxicology (1994), 92(1-3), 229-43; Descotes, et al., Developments in biological standardization (1992), 77 99-102; Hart et al., Journal of Allergy and Clinical Immunology (2001), 108(2), 250-257). Whether a DVD-binding protein will be useful for the treatment of rheumatoid arthritis can be assessed using pre-clinical animal RA models such as the collagen-induced arthritis mouse model. Other useful models are also well known in the art (see Brand D D., *Comp. Med.*, (2005) 55(2):114-22). Based on the cross-reactivity of the parental antibodies for human and mouse othologues (e.g., reactivity for human and mouse TNF, human and mouse IL-15 etc.) validation studies in the mouse CIA model may be conducted with "matched surrogate antibody" derived DVD-binding proteins; briefly, a DVD-binding protein based on two (or more) mouse target specific antibodies may be matched to the extent possible to the characteristics of the parental human or humanized antibodies used for human DVD-binding protein construction (similar affinity, similar neutralization potency, similar half-life etc.).

An embodiment provides a DVD-binding protein that binds human sclerostin and another non-sclerostin target that may also be used to treat other diseases in which SOST plays a role. Such diseases include, but are not limited to SLE, multiple sclerosis (MS), sepsis, various neurological diseases, and cancers (including cervical, breast, gastric). A more extensive list of diseases and disorders in which sclerostin plays a role is also provided below.

An embodiment provides a DVD-binding protein capable of binding huSOST and one or more targets of TNFα, IL-12, TWEAK, IL-23, CXCL13, CD40, CD40L, IL-18, VEGF, VLA-4, TNFβ, CD45RB, CD200, IFN-γ, GM-CSF, FGF, C5, CD52, sclerostin, or CCR2.

VI.C. SLE (Lupus)

The immunopathogenic hallmark of SLE is the polyclonal B cell activation, which leads to hyperglobulinemia, autoantibody production and immune complex formation. The fundamental abnormality appears to be the failure of T cells to suppress the forbidden B cell clones due to generalized T cell dysregulation. In addition, B and T-cell interaction is facilitated by several cytokines such as IL-10 as well as co-stimulatory molecules such as CD40 and CD40L, B7 and CD28 and CTLA-4, which initiate the second signal. These interactions together with impaired phagocytic clearance of immune complexes and apoptotic material, perpetuate the immune response with resultant tissue injury.

One aspect provides a DVD-binding protein capable of binding human sclerostin and one or more of the following antigens that have been implicated in SLE: B cell targeted therapies: CD-20, CD-22, CD-19, CD28, CD4, CD80, HLA-DRA, IL10, IL2, IL4, TNFRSF5, TNFRSF6, TNFSF5, TNFSF6, BLR1, HDAC4, HDAC5, HDAC7A, HDAC9, ICOSL, IGBP1, MS4A1, RGS1, SLA2, CD81, IFNB1, IL10, TNFRSF5, TNFRSF7, TNFSF5, AICDA, BLNK, GALNAC4S-6ST, HDAC4, HDAC5, HDAC7A, HDAC9, IL10, IL11, IL4, INHA, INHBA, KLF6, TNFRSF7, CD28, CD38, CD69, CD80, CD83, CD86, DPP4, FCER2, IL2RA, TNFRSF8, TNFSF7, CD24, CD37, CD40, CD72, CD74, CD79A, CD79B, CR2, IL1R2, ITGA2, ITGA3, MS4A1, ST6GAL1, CD1C, CHST10, HLA-A, HLA-DRA, and NT5E; co-stimulatory signals: CTLA4 or B7.1/B7.2; inhibition of B cell survival: BlyS, BAFF; Complement inactivation: C5; Cytokine modulation: the key principle is that the net biologic response in any tissue is the result of a balance between local levels of proinflammatory or anti-inflammatory cytokines (see Sfikakis P P et al 2005 Curr Opin Rheumatol 17:550-7). SLE is considered to be a Th-2 driven disease with documented elevations in serum IL-4, IL-6, IL-10. DVD-binding proteins capable of binding IL-4, IL-6, IL-10, IFN-α, or TNF-α are also contemplated. Combination of targets discussed herein will enhance therapeutic efficacy for SLE which can be tested in a number of lupus preclinical models (see, Peng S L (2004) *Methods Mol. Med.*, 102: 227-72). Based on the cross-reactivity of the parental antibodies for human and mouse othologues (e.g., reactivity for human and mouse CD20, human and mouse Interferon alpha etc.) validation studies in a mouse lupus model may be conducted with "matched surrogate antibody" derived DVD-binding proteins; briefly, a DVD-binding protein based two (or more) mouse target specific antibodies may be matched to the extent possible to the characteristics of the parental human or humanized antibodies used for human DVD-binding protein construction (similar affinity, similar neutralization potency, similar half-life etc.)

VI.D. Multiple Sclerosis (MS)

Multiple sclerosis (MS) is a complex human autoimmune-type disease with a predominantly unknown etiology. Immunologic destruction of myelin basic protein (MBP) throughout the nervous system is the major pathology of multiple sclerosis. MS is a disease of complex pathologies, which involves infiltration by CD4+ and CD8+ T cells and of response within the central nervous system. Expression in the CNS of cytokines, reactive nitrogen species and costimulator molecules have all been described in MS. Of major consideration are immunological mechanisms that contribute to the development of autoimmunity In particular, antigen expression, cytokine and leukocyte interactions, and regulatory T-cells, which help balance/modulate other T-cells such as Th1 and Th2 cells, are important areas for therapeutic target identification.

IL-12 is a proinflammatory cytokine that is produced by APC and promotes differentiation of Th1 effector cells. IL-12 is produced in the developing lesions of patients with MS as well as in EAE-affected animals. Previously it was shown that interference in IL-12 pathways effectively prevents EAE in rodents, and that in vivo neutralization of IL-12p40 using a anti-IL-12 mAb has beneficial effects in the myelin-induced EAE model in common marmosets.

TWEAK is a member of the TNF family, constitutively expressed in the central nervous system (CNS), with pro-inflammatory, proliferative or apoptotic effects depending upon cell types. Its receptor, Fn14, is expressed in CNS by endothelial cells, reactive astrocytes and neurons. TWEAK and Fn14 mRNA expression increased in spinal cord during experimental autoimmune encephalomyelitis (EAE). Anti-TWEAK antibody treatment in myelin oligodendrocyte glycoprotein (MOG) induced EAE in C57BL/6 mice resulted in a reduction of disease severity and leukocyte infiltration when mice were treated after the priming phase.

One aspect provides DVD-binding proteins capable of binding SOST and one or more, for example two, targets including IL-12, TWEAK, IL-23, CXCL13, CD40, CD40L, IL-18, VEGF, VLA-4, TNF, CD45RB, CD200, IFNgamma, GM-CSF, FGF, C5, CD52, osteopontin, and/or CCR2. An embodiment includes a dual-specific anti-sclerostin/TNF-α DVD-binding protein as a therapeutic agent beneficial for the treatment of MS.

Several animal models for assessing the usefulness of the DVD-binding protein molecules to treat MS are known in the art (see Steinman L, et al., (2005) Trends Immunol. 26(11): 565-71; Lublin F D., et al., (1985) Springer Semin Immunopathol.8(3):197-208; Genain C P, et al., (1997) J Mol. Med. 75(3):187-97; Tuohy V K, et al., (1999) J Exp Med. 189(7): 1033-42; Owens T, et al., (1995) Neurol Clin. 13(1):51-73; and 't Hart et al., *J. Immunol.*, 175(7): 4761-4768 (2005). Based on the cross-reactivity of the parental antibodies for human and animal species othologues (e.g., reactivity for human and mouse SOST, human and mouse TWEAK etc.) validation studies in the mouse EAE model may be conducted with "matched surrogate antibody" derived DVD-binding protein molecules; briefly, a DVD-binding protein based on to (or more) mouse target specific antibodies may be matched to the extent possible to the characteristics of the parental human or humanized antibodies used for human DVD-binding protein construction (similar affinity, similar neutralization potency, similar half-life etc.). The same concept applies to animal models in other non-rodent species, where a "matched surrogate antibody" derived DVD-binding protein would be selected for the anticipated pharmacology and possibly safety studies. In addition to routine safety assessments of these target pairs specific tests for the degree of immunosuppression may be warranted and helpful in selecting the best target pairs (see Luster et al., Toxicology (1994), 92(1-3), 229-43; Descotes, et al., Developments in biological standardization (1992), 77 99-102; Jones R. 2000 Rovelizumab (ICOS Corp). IDrugs.3(4):442-6).

VI.E. Sepsis

The pathophysiology of sepsis is initiated by the outer membrane components of both gram-negative organisms (lipopolysaccharide [LPS], lipid A, endotoxin) and gram-positive organisms (lipoteichoic acid, peptidoglycan). These outer membrane components are able to bind to the CD14 receptor on the surface of monocytes. By virtue of the recently described toll-like receptors, a signal is then transmitted to the cell, leading to the eventual production of the proinflammatory cytokines tumor necrosis factor-alpha (TNF-alpha) and interleukin-1 (IL-1). Overwhelming inflammatory and immune responses are essential features of septic shock and play a central part in the pathogenesis of tissue damage, multiple organ failure, and death induced by sepsis. Cytokines, especially tumor necrosis factor (TNF) and interleukin (IL-1), have been shown to be critical mediators of septic shock. These cytokines have a direct toxic effect on tissues; they also activate phospholipase A2. These and other effects lead to increased concentrations of platelet-activating factor, promotion of nitric oxide synthase activity, promotion of tissue infiltration by neutrophils, and promotion of neutrophil activity.

The treatment of sepsis and septic shock remains a clinical conundrum, and recent prospective trials with biological response modifiers (i.e. anti-TNF, anti-MIF) aimed at the inflammatory response have shown only modest clinical benefit. Recently, interest has shifted toward therapies aimed at reversing the accompanying periods of immune suppression. Studies in experimental animals and critically ill patients have demonstrated that increased apoptosis of lymphoid organs and some parenchymal tissues contribute to this immune suppression, anergy, and organ system dysfunction. During sepsis syndromes, lymphocyte apoptosis can be triggered by the absence of IL-2 or by the release of glucocorticoids, granzymes, or the so-called 'death' cytokines: tumor necrosis factor alpha or Fas ligand. Apoptosis proceeds via auto-activation of cytosolic and/or mitochondrial caspases, which can be influenced by the pro- and anti-apoptotic members of the Bcl-2 family. In experimental animals, not only can treatment with inhibitors of apoptosis prevent lymphoid cell apoptosis; it may also improve outcome. Although clinical trials with anti-apoptotic agents remain distant due in large part to technical difficulties associated with their administration and tissue targeting, inhibition of lymphocyte apoptosis represents an attractive therapeutic target for the septic patient. Likewise, a dual-specific agent targeting both inflammatory mediator and a apoptotic mediator, may have added benefit. One aspect provides DVD-binding proteins capable of binding sclerostin and one or more targets involved in sepsis, including TNF, IL-1, MIF, IL-6, IL-8, IL-18, IL-12, IL-23, FasL, LPS, Toll-like receptors, TLR-4, tissue factor, MIP-2, ADORA2A, CASP1, CASP4, IL-10, IL-1B, NFKB1, PROC, TNFRSF1A, CSF3, CCR3, IL1RN, MIF, NFKB1, PTAFR, TLR2, TLR4, GPR44, HMOX1, HMG-B1, midkine, IRAK1, NFKB2, SERPINA1, SERPINE1, or TREM1. The efficacy of such DVD-binding proteins for sepsis can be assessed in preclinical animal models known in the art (see, Buras J A, et al., (2005) Nat. Rev. Drug Discov., 4(10): 854-65 and Calandra T, et al., (2000) Nat. Med., 6(2):164-70).

VI.F. Neurological Disorders and Neurodegenerative Diseases

Neurodegenerative diseases are either chronic in which case they are usually age-dependent or acute (e.g., stroke, traumatic brain injury, spinal cord injury, etc.). They are characterized by progressive loss of neuronal functions (neuronal cell death, demyelination), loss of mobility and loss of memory. Emerging knowledge of the mechanisms underlying chronic neurodegenerative diseases (e.g., Alzheimer's disease, AD) show a complex etiology and a variety of factors have been recognized to contribute to their development and progression e.g., age, glycemic status, amyloid production and multimerization, accumulation of advanced glycation-end products (AGE) which bind to their receptor RAGE (receptor for AGE), increased brain oxidative stress, decreased cerebral blood flow, neuroinflammation including release of inflammatory cytokines and chemokines, neuronal dysfunction and microglial activation. Thus these chronic neurodegenerative diseases represent a complex interaction between multiple cell types and mediators. Treatment strategies for such diseases are limited and mostly constitute either blocking inflammatory processes with non-specific anti-inflammatory agents (e.g., corticosteroids, COX inhibitors) or agents to prevent neuron loss and/or synaptic functions. These treatments fail to stop disease progression. Recent studies suggest that more targeted therapies such as antibodies to soluble Aβ peptide (including the Aβ oligomeric forms) can not only help stop disease progression but may help maintain memory as well. These preliminary observations suggest that specific therapies targeting more than one disease mediator (e.g., Aβ and a pro-inflammatory cytokine such as TNF) may provide even better therapeutic efficacy for chronic neurodegenerative diseases than observed with targeting a single disease mechanism (e.g., soluble Aβ alone) (see C. E. Shepherd, et al, Neurobiol Aging. 2005 Oct. 24; Nelson R B., Curr Pharm Des. 2005; 11:3335; William L. Klein.; Neurochem Int. 2002; 41:345; Janelsins et al., "Early correlation of microglial activation with enhanced tumor necrosis factor-alpha and monocyte chemoattractant protein-I expression specifically within the entorhinal cortex of triple transgenic Alzheimer's disease mice," *Journal of Neuroinflammation*, 2(23): 1-12 (2005); Soloman B., Curr Alzheimer Res. 2004; 1:149; Igor Klyubin, et al., Nat. Med. 2005; 11:556-61; Arancio O, et al., EMBO Journal (2004) 1-10; Bornemann K D, et al., Am J. Pathol. 2001; 158:63; Deane R, et al., Nat. Med. 2003; 9:907-13; and Eliezer Masliah, et al., Neuron. 2005; 46:857).

The DVD-binding proteins can bind sclerostin and one or more targets involved in chronic neurodegenerative diseases such as Alzheimers. Such targets include, but are not limited to, any mediator, soluble or cell surface, implicated in AD pathogenesis, e.g., AGE (S100 A, amphotericin), pro-inflammatory cytokines (e.g., IL-1), chemokines (e.g., MCP 1), molecules that inhibit nerve regeneration (e.g., Nogo, RGM A), molecules that enhance neurite growth (neurotrophins) and molecules that can mediate transport at the blood brain barrier (e.g., transferrin receptor, insulin receptor or RAGE). The efficacy of DVD-binding proteins can be validated in pre-clinical animal models such as the transgenic mice that over-express amyloid precursor protein or RAGE and develop Alzheimer's disease-like symptoms. In addition, DVD-binding proteins can be constructed and tested for efficacy in the animal models and the best therapeutic DVD-binding protein can be selected for testing in human patients. DVD-binding proteins can also be employed for treatment of other neurodegenerative diseases such as Parkinson's disease. Alpha-Synuclein is involved in Parkinson's pathology. A DVD-binding protein capable of targeting sclerostin and LINGO-1, alpha-synuclein, and/or inflammatory mediators such as TNF, IL-1, MCP-1 can prove effective therapy for Parkinson's disease and are contemplated.

VI.G. Neuronal Regeneration and Spinal Cord Injury

Despite an increase in knowledge of the pathologic mechanisms, spinal cord injury (SCI) is still a devastating condition and represents a medical indication characterized by a high medical need. Most spinal cord injuries are contusion or compression injuries and the primary injury is usually followed by secondary injury mechanisms (inflammatory mediators e.g., cytokines and chemokines) that worsen the initial injury and result in significant enlargement of the lesion area, sometimes more than 10-fold. These primary and secondary mechanisms in SCI are very similar to those in brain injury caused by other means e.g., stroke. No satisfying treatment exists and high dose bolus injection of methylprednisolone (MP) is the only used therapy within a narrow time window of 8 h post injury. This treatment, however, is only intended to prevent secondary injury without causing any significant functional recovery. It is heavily criticized for the lack of unequivocal efficacy and severe adverse effects, like immunosuppression with subsequent infections and severe histopathological muscle alterations. No other drugs, biologics or small molecules, stimulating the endogenous regenerative potential are approved, but promising treatment principles and drug candidates have shown efficacy in animal models of SCI in recent years. To a large extent the lack of functional recovery in human SCI is caused by factors inhibiting neurite growth, at lesion sites, in scar tissue, in myelin as well as on injury-associated cells. Such factors are the myelin-associated proteins NogoA, OMgp and MAG, RGM A, the scar-associated CSPG (Chondroitin Sulfate Proteoglycans) and inhibitory factors on reactive astrocytes (some semaphorins and ephrins). However, at the lesion site not only growth inhibitory molecules are found but also neurite growth stimulating factors like neurotrophins, laminin, L1 and others. This ensemble of neurite growth inhibitory and growth promoting molecules may explain that blocking single factors, like NogoA or RGM A, resulted in significant functional recovery in rodent SCI models, because a reduction of the inhibitory influences could shift the balance from growth inhibition to growth promotion. However, recoveries observed with blocking a single neurite outgrowth inhibitory molecule were not complete. To achieve faster and more pronounced recoveries either blocking two neurite outgrowth inhibitory molecules, e.g., Nogo and RGM A, or blocking an neurite outgrowth inhibitory molecule and enhancing functions of a neurite outgrowth enhancing molecule, e.g., Nogo and neurotrophins, or blocking a neurite outgrowth inhibitory molecule, e.g., Nogo and a pro-inflammatory molecule e.g., TNF, may be desirable (see McGee A W, et al. (2003) *Trends Neurosci.*, 26: 193; Marco Domeniconi, et al. (2005) *J. Neurol. Sci.*, 233: 43; Milan Makwanal, et al. (2005) FEBS J. 272:2628; Barry J. Dickson (2002) *Science*, 298: 1959; Felicia Yu Hsuan Teng, et al. (2005) J. Neurosci. Res. 79:273; Tara Karnezis, et al. (2004) *Nature Neuroscience*, 7: 736; Gang Xu, et al. (2004) *J. Neurochem.*, 91: 1018).

In one aspect, a DVD-binding protein that binds human sclerostin may also bind one or both of the target pairs such as NgR and RGM A; NogoA and RGM A; MAG and RGM A; OMGp and RGM A; RGM A and RGM B; CSPGs and RGM A; aggrecan, midkine, neurocan, versican, phosphacan, Te38 and TNF-α; Aβ globulomer-specific antibodies combined with antibodies promoting dendrite & axon sprouting are provided. Dendrite pathology is a very early sign of AD and it is known that NOGO A restricts dendrite growth. One can combine such type of ab with any of the SCI-candidate (myelin-proteins) Ab. Other DVD-binding protein targets may include any combination of NgR-p75, NgR-Troy, NgR-Nogo66 (Nogo), NgR-Lingo, Lingo-Troy, Lingo-p75, MAG or Omgp. Additionally, targets may also include any mediator, soluble or cell surface, implicated in inhibition of neurite, e.g., Nogo, Ompg, MAG, RGM A, semaphorins, ephrins, soluble Aβ, pro-inflammatory cytokines (e.g., IL-1), chemokines (e.g., MIP 1a), molecules that inhibit nerve regeneration. The efficacy of anti-nogo/anti-RGM A or similar DVD-binding proteins can be validated in pre-clinical animal models of spinal cord injury. In addition, these DVD-binding proteins can be constructed and tested for efficacy in the animal models and the best therapeutic DVD-binding protein can be selected for testing in human patients. In addition, DVD-binding protein can be constructed that target two distinct ligand binding sites on a single receptor e.g., Nogo receptor which binds three ligand Nogo, Ompg, and MAG and RAGE that binds Aβ and S100A. Furthermore, neurite outgrowth inhibitors e.g., nogo and nogo receptor, also play a role in preventing nerve regeneration in immunological diseases like multiple sclerosis Inhibition of nogo-nogo receptor interaction has been shown to enhance recovery in animal models of multiple sclerosis. Therefore, DVD-binding proteins that can block the function of one immune mediator, e.g., a cytokine like IL-12, and a neurite outgrowth inhibitor molecule, e.g., Nogo or RGM, may offer faster and greater efficacy than blocking either an immune or a neurite outgrowth inhibitor molecule alone.

In general, antibodies do not cross the blood brain barrier (BBB) in an efficient and relevant manner However, in certain neurologic diseases, e.g., stroke, traumatic brain injury, multiple sclerosis, etc., the BBB may be compromised and allows for increased penetration of DVD-binding proteins and antibodies into the brain. In other neurological conditions, where BBB leakage is not occurring, one may employ the targeting of endogenous transport systems, including carrier-mediated transporters such as glucose and amino acid carriers and receptor-mediated transcytosis-mediating cell structures/receptors at the vascular endothelium of the BBB, thus enabling trans-BBB transport of the DVD-binding protein. Structures at the BBB enabling such transport include but are not limited to the insulin receptor, transferrin receptor, LRP and RAGE. In addition, strategies enable the use of DVD-binding proteins also as shuttles to transport potential drugs into the CNS including low molecular weight drugs, nanoparticles and nucleic acids (Coloma M J, et al. (2000) Pharm Res. 17(3): 266-74; Boado R J, et al. (2007) Bioconjug. Chem. 18(2): 447-55).

VI.H. Oncological Disorders

Monoclonal antibody therapy has emerged as an important therapeutic modality for cancer (von Mehren et al., *Annu. Rev. Med.*, 54: 343-69 (2003)). Antibodies may exert antitumor effects by inducing apoptosis, redirected cytotoxicity, interfering with ligand-receptor interactions, or preventing the expression of proteins that are critical to the neoplastic phenotype. In addition, antibodies can target components of the tumor microenvironment, perturbing vital structures such as the formation of tumor-associated vasculature. Antibodies can also target receptors whose ligands are growth factors, such as the epidermal growth factor receptor. The antibody thus inhibits natural ligands that stimulate cell growth from binding to targeted tumor cells. Alternatively, antibodies may induce an anti-idiotype network, complement-mediated cytotoxicity, or antibody-dependent cellular cytotoxicity (ADCC). The use of dual-specific antibody that targets two separate tumor mediators will likely give additional benefit compared to a mono-specific therapy.

Another embodiment provides a DVD-binding protein that binds human sclerostin may also be capable of binding another target involved in oncological diseases including, but not limited to: IGFR, IGF, VGFR1, PDGFRb, PDGFRa, IGF1,2, ERB3, CDCP, 1BSG2, ErbB3, CD52, CD20, CD19, CD3, CD4, CD8, BMP6, IL12A, ILIA, IL1B, IL2, IL24, INHA, TNF, TNFSF10, BMP6, EGF, FGF1, FGF10, FGF11, FGF12, FGF13, FGF14, FGF16, FGF17, FGF18, FGF19, FGF2, FGF20, FGF21, FGF22, FGF23, FGF3, FGF4, FGF5, FGF6, FGF7, FGF8, FGF9, GRP, IGF1, IGF2, IL12A, IL1A, IL1B, IL2, INHA, TGFA, TGFB1, TGFB2, TGFB3, VEGF, CDK2, FGF10, FGF18, FGF2, FGF4, FGF7, IGF1R, IL2, BCL2, CD164, CDKN1A, CDKN1B, CDKN1C, CDKN2A, CDKN2B, CDKN2C, CDKN3, GNRH1, IGFBP6, IL1A, IL1B, ODZ1, PAWR, PLG, TGFB1I1, AR, BRCA1, CDK3, CDK4, CDK5, CDK6, CDK7, CDK9, E2F1, EGFR, ENO$_1$, ERBB2, ESR1, ESR2, IGFBP3, IGFBP6, IL2, INSL4, MYC, NOX5, NR6A1, PAP, PCNA, PRKCQ, PRKD1, PRL, TP53, FGF22, FGF23, FGF9, IGFBP3, IL2, INHA, KLK6, TP53, CHGB, GNRH1, IGF1, IGF2, INHA, INSL3, INSL4, PRL, KLK6, SHBG, NR1D1, NR1H3, NR113, NR2F6, NR4A3, ESR1, ESR2, NR0B1, NR0B2, NR1D2, NR1H2, NR1H4, NR112, NR2C1, NR2C2, NR2E1, NR2E3, NR2F1, NR2F2, NR3C1, NR3C2, NR4A1, NR4A2, NR5A1, NR5A2, NR6A1, PGR, RARB, FGF1, FGF2, FGF6, KLK3, KRT1, APOCl, BRCA1, CHGA, CHGB, CLU, COL1A1, COL6A1, EGF, ERBB2, ERK8, FGF1, FGF10, FGF11, FGF13, FGF14, FGF16, FGF17, FGF18, FGF2, FGF20, FGF21, FGF22, FGF23, FGF3, FGF4, FGF5, FGF6, FGF7, FGF8, FGF9, GNRH1, IGF1, IGF2, IGFBP3, IGFBP6, IL12A, IL1A, IL1B, IL2, IL24, INHA, INSL3, INSL4, KLK10, KLK12, KLK13, KLK14, KLK15, KLK3, KLK4, KLK5, KLK6, KLK9, MMP2, MMP9, MSMB, NTN4, ODZ1, PAP, PLAU, PRL, PSAP, SERPINA3, SHBG, TGFA, TIMP3, CD44, CDH1, CDH10, CDH19, CDH20, CDH7, CDH9, CDH1, CDH10, CDH13, CDH18, CDH19, CDH20, CDH7, CDH8, CDH9, ROBO2, CD44, ILK, ITGA1, APC, CD164, COL6A1, MTSS1, PAP, TGFB1I1, AGR2, AIG1, AKAP1, AKAP2, CANT1, CAV1, CDH12, CLDN3, CLN3, CYB5, CYC1, DAB21P, DES, DNCL1, ELAC2, ENO$_2$, ENO$_3$, FASN, F1112584, F1125530, GAGEB1, GAGEC1, GGT1, GSTP1, HIP1, HUMCYT2A, IL29, K$_6$HF, KAI1, KRT2A, MIB1, PART1, PATE, PCA3, PIAS2, PIK3CG, PPID, PR1, PSCA, SLC2A2, SLC33A1, SLC43A1, STEAP, STEAP2, TPM1, TPM2, TRPC6, ANGPT1, ANGPT2, ANPEP, ECGF1, EREG, FGF1, FGF2, FIGF, FLT1, JAG1, KDR, LAMA5, NRP1, NRP2, PGF, PLXDC1, STAB1, VEGF, VEGFC, ANGPTL3, BAH, COL4A3, IL8, LAMA5, NRP1, NRP2, STAB1, ANGPTL4, PECAM1, PF4, PROK2, SERPINF1, TNFAIP2, CCL11, CCL2, CXCL1, CXCL10, CXCL3, CXCL5, CXCL6, CXCL9, IFNα1, IFNB1, IFNG, IL1B, IL6, MDK, EDG1, EFNA1, EFNA3, EFNB2, EGF, EPHB4, FGFR3, HGF, IGF1, ITGB3, PDGFA, TEK, TGFA, TGFB1, TGFB2, TGFBR1, CCL2, CDH5, COL18A1, EDG1, ENG, ITGAV, ITGB3, THBS1, THBS2, BAD, BAG1, BCL2, CCNA1, CCNA2, CCND1, CCNE1, CCNE2, CDH1 (E-cadherin), CDKN1B (p27Kipl), CDKN2A (p161NK4a), COL6A1, CTNNB1 (b-catenin), CTSB (cathepsin B), ERBB2 (Her-2), ESR1, ESR2, F3 (TF), FOSL1 (FRA-1), GATA3, GSN (Gelsolin), IGFBP2, IL2RA, IL6, IL6R, IL6ST (glycoprotein 130), ITGA6 (a6 integrin), JUN, KLK5, KRT19, MAP2K$_7$ (c-Jun), MKI67 (Ki-67), NGFB (NGF), NGFR, NME1 (NM23A), PGR, PLAU (uPA), PTEN, SERPINB5 (maspin), SERPINE1 (PAI-1), TGFA, THBS1 (thrombospondin-1), TIE (Tie-1), TNFRSF6 (Fas), TNFSF6 (FasL), TOP2A (topoisomerase Ea), TP53, AZGP1 (zinc-a-glycoprotein), BPAG1 (plectin), CDKN1A (p21Wap1/Cip1), CLDN7 (claudin-7), CLU (clusterin), ERBB2 (Her-2), FGF1, FLRT1 (fibronectin), GABRP (GABAa), GNAS1, ID2, ITGA6 (a6 integrin), ITGB4 (b 4 integrin), KLF5 (GC Box BP), KRT19 (Keratin 19), KRTHB6 (hair-specific type II keratin), MACMARCKS, MT3 (metallothionectin-III), MUC1 (mucin), PTGS2 (COX-2), RAC2 (p21Rac2), S100A2, SCGB1D2 (lipophilin B), SCGB2A1 (mammaglobin 2), SCGB2A2 (mammaglobin 1), SPRR1B (Sprl), THBS1, THBS2, THBS4, and TNFAIP2 (B94), RON, c-Met, CD64, DLL4, PLGF, CTLA4, phosphatidylserine, ROBO4, CD80, CD22, CD40, CD23, CD28, CD55, CD38, CD70, CD74, CD30, CD138, CD56, CD33, CD2, CD137, DR4, DR5, RANKL, VEGFR2, PDGFR, VEGFR1, MTSP1, MSP, EPHB2, EPHAl, EPHA2, EpCAM, PGE2, NKG2D, LPA, SIP, APRIL, BCMA, MAPG, FLT3, PDGFR alpha, PDGFR beta, ROR1, PSMA, PSCA, SCD1, and CD59.

VII. Pharmaceutical Composition

A pharmaceutical compositions comprising an antibody, or antigen-binding portion thereof, of the invention and a pharmaceutically acceptable carrier is provided. The pharmaceutical compositions comprising antibodies are provided and are for use in, but not limited to, diagnosing, detecting, or monitoring a disorder, in preventing, treating, managing, or ameliorating of a disorder or one or more symptoms thereof, and/or in research. In a specific embodiment, a composition comprises one or more antibodies is provided. In another provided embodiment, the pharmaceutical composition comprises one or more antibodies and one or more prophylactic or therapeutic agents other than antibodies treating a disorder in which SOST activity is detrimental. In an embodiment, the prophylactic or therapeutic agents are known to be useful for or having been or currently being used in the prevention, treatment, management, or amelioration of a disorder or one or more symptoms thereof. In accordance with these embodiments, the composition may further comprise of a carrier, diluent or excipient.

The antibodies and antibody portions can be incorporated into pharmaceutical compositions suitable for administration to a subject. Typically, the pharmaceutical composition comprises an antibody or antibody portion and a pharmaceutically acceptable carrier. The term "pharmaceutically acceptable carrier" includes any and all solvents, dispersion media, coatings, antibacterial and antifungal agents, isotonic and absorption delaying agents, and the like that are physiologically compatible. Examples of pharmaceutically acceptable carriers include one or more of water, saline, phosphate buffered saline, dextrose, glycerol, ethanol and the like, as well as combinations thereof. In many cases, it will be preferable to include isotonic agents, for example, sugars, polyalcohols such as mannitol, sorbitol, or sodium chloride in the composition. Pharmaceutically acceptable carriers may further comprise minor amounts of auxiliary substances such as wetting or emulsifying agents, preservatives or buffers, which enhance the shelf life or effectiveness of the antibody or antibody portion.

Various delivery systems are known and can be used to administer one or more antibodies or the combination of one or more antibodies and a prophylactic agent or therapeutic agent useful for preventing, managing, treating, or ameliorating a disorder or one or more symptoms thereof, e.g., encapsulation in liposomes, microparticles, microcapsules, recombinant cells capable of expressing the antibody or antibody fragment, receptor-mediated endocytosis (see, e.g., Wu and Wu, *J. Biol. Chem.*, 262: 4429-4432 (1987)), construction of a nucleic acid as part of a retroviral or other vector. Methods of administering a prophylactic or therapeutic agent are provided and include, but are not limited to, parenteral administration (e.g., intradermal, intramuscular, intraperitoneal, intravenous and subcutaneous), epidural administration, intratumoral administration, and mucosal administration (e.g., intranasal and oral routes). In addition, pulmonary administration can be employed, e.g., by use of an inhaler or nebulizer, and formulation with an aerosolizing agent. See, e.g., U.S. Pat. Nos. 6,019,968; 5,985,320; 5,985,309; 5,934,272; 5,874,064; 5,855,913; 5,290,540; and 4,880,078; and PCT Publication Nos. WO 92/19244, WO 97/32572, WO 97/44013, WO 98/31346, and WO 99/66903. One embodiment provides an antibody or antibody portion, combination therapy, or a composition administered using Alkermes AIR® pulmonary drug delivery technology (Alkermes, Inc., Cambridge, Mass., US). In a provided specific embodiment, prophylactic or therapeutic agents are administered intramuscularly, intravenously, intratumorally, orally, intranasally, pulmonary, or subcutaneously. The prophylactic or therapeutic agents may be administered by any convenient route, for example by infusion or bolus injection, by absorption through epithelial or mucocutaneous linings (e.g., oral mucosa, rectal, and intestinal mucosa, etc.) and may be administered together with other biologically active agents Administration can be systemic or local.

In an embodiment, specific binding of antibody-coupled carbon nanotubes (CNTs) to tumor cells in vitro, followed by their highly specific ablation with near-infrared (NIR) light can be used to target tumor cells. For example, biotinylated polar lipids can be used to prepare stable, biocompatible, noncytotoxic CNT dispersions that are then attached to one or two different neutralite avidin-derivatized DVD-binding proteins directed against one or more tumor antigens (e.g., CD22) (Chakravarty, P. et al. (2008) *Proc. Natl. Acad. Sci. USA*, 105:8697-8702).

A specific embodiment provides it may be desirable to administer the prophylactic or therapeutic agents locally to the area in need of treatment; this may be achieved by, for example, and not by way of limitation, local infusion, by injection, or by means of an implant, said implant being of a porous or non-porous material, including membranes and matrices, such as sialastic membranes, polymers, fibrous matrices (e.g., Tissuel®), or collagen matrices. One embodiment provides an effective amount of one or more antibody antagonists is administered locally to the affected area to a subject to prevent, treat, manage, and/or ameliorate a disorder or a symptom thereof. Another embodiment provides an effective amount of one or more antibodies administered locally to the affected area of a subject in combination with an effective amount of one or more therapies (e.g., one or more prophylactic or therapeutic agents) other than an antibody to prevent, treat, manage, and/or ameliorate a disorder or one or more symptoms thereof.

In another embodiment, the prophylactic or therapeutic agent can be delivered in a controlled release or sustained release system. In one embodiment, a pump may be used to achieve controlled or sustained release (see Langer, supra; Sefton, 1987, *CRC Crit. Ref. Biomed. Eng.*, 14: 20; Buchwald et al., 1980, *Surgery*, 88: 507; Saudek et al., 1989, *N. Engl. J. Med.*, 321: 574). Another embodiment provides polymeric materials can be used to achieve controlled or sustained release of the therapies (see, e.g., Goodson, J. M., Chapter 6, In Medical Applications of Controlled Release, Vol. II, Applications and Evaluation, (Langer and Wise, eds.) (CRC Press, Inc., Boca Raton, 1984), pp. 115-138; Ranger and Peppas, 1983, J. Macromol. Sci. Rev. Macromol. Chem. 23:61; see also Levy et al., 1985, Science 228:190; During et al., 1989, Ann. Neurol. 25:351; Howard et al., 1989, J. Neurosurg. 7 1:105); U.S. Pat. No. 5,679,377; U.S. Pat. No. 5,916,597; U.S. Pat. No. 5,912,015; U.S. Pat. No. 5,989,463; U.S. Pat. No. 5,128,326; PCT Publication No. WO 99/15154; and PCT Publication No. WO 99/20253. Examples of polymers used in sustained release formulations include, but are not limited to, poly(2-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. In an embodiment, the polymer used in a sustained release formulation is inert, free of leachable impurities, stable on storage, sterile, and biodegradable. In yet another embodiment, a controlled or sustained release system can be placed in proximity of the prophylactic or therapeutic target, thus requiring only a fraction of the systemic dose (see, e.g., Goodson, in Medical Applications of Controlled Release, supra, vol. 2, pp. 115-138 (1984)).

Controlled release systems are discussed in the review by Langer (1990, Science 249:1527-1533). Any technique known to one of skill in the art are provided and can be used to produce sustained release formulations comprising one or more therapeutic agents. See, e.g., U.S. Pat. No. 4,526,938, PCT publication WO 91/05548, PCT publication WO 96/20698, Ning et al., 1996, "Intratumoral Radioimmunotherapy of a Human Colon Cancer Xenograft Using a Sustained-Release Gel," *Radiotherapy & Oncology*, 39: 179-189, Song et al., 1995, "Antibody Mediated Lung Targeting of Long-Circulating Emulsions," PDA Journal of Pharmaceutical Science &Technology, 50: 372-397, Cleek et al., 1997, "Biodegradable Polymeric Carriers for a bFGF Antibody for Cardiovascular Application," Pro. Int'l. Symp. Control. Rel. Bioact. Mater. 24: 853-854, and Lam et al., 1997, "Microencapsulation of Recombinant Humanized Monoclonal Antibody for Local Delivery," Proc. Int'l. Symp. Control Rel. Bioact. Mater. 24:759-760.

A specific embodiment provides where the composition is a nucleic acid encoding a prophylactic or therapeutic agent, the nucleic acid can be administered in vivo to promote expression of its encoded prophylactic or therapeutic agent, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see, e.g., Joliot et al., 1991, *Proc. Natl. Acad. Sci. USA*, 88: 1864-1868). Alternatively, a nucleic acid can be introduced intracellularly and incorporated within host cell DNA for expression by homologous recombination.

A pharmaceutical composition formulated to be compatible with its intended route of administration is provided. Examples of routes of administration include, but are not limited to, parenteral, e.g., intravenous, intradermal, subcutaneous, oral, intranasal (e.g., inhalation), transdermal (e.g., topical), transmucosal, and rectal administration. In a specific embodiment, the composition is formulated in accordance with routine procedures as a pharmaceutical composition adapted for intravenous, subcutaneous, intramuscular, oral, intranasal, or topical administration to human beings. Typically, compositions for intravenous administration are solutions in sterile isotonic aqueous buffer. Where necessary, the composition may also include a solubilizing agent and a local anesthetic, such as lignocamne, to ease pain at the site of the injection.

If the compositions are to be administered topically, the compositions can be formulated in the form of an ointment, cream, transdermal patch, lotion, gel, shampoo, spray, aerosol, solution, emulsion, or other form well-known to one of skill in the art. See, e.g., Remington's Pharmaceutical Sciences and Introduction to Pharmaceutical Dosage Forms, 19th ed., Mack Pub. Co., Easton, Pa. (1995). For non-sprayable topical dosage forms, viscous to semi-solid or solid forms comprising a carrier or one or more excipients compatible with topical application and having a dynamic viscosity, e.g., greater than water are typically employed. Suitable formulations include, without limitation, solutions, suspensions, emulsions, creams, ointments, powders, liniments, salves, and the like, which are, if desired, sterilized or mixed with auxiliary agents (e.g., preservatives, stabilizers, wetting agents, buffers, or salts) for influencing various properties, such as, for example, osmotic pressure. Other suitable topical dosage forms include sprayable aerosol preparations wherein the active ingredient, e.g., in combination with a solid or liquid inert carrier, is packaged in a mixture with a pressurized volatile (e.g., a gaseous propellant, such as FREON®) or in a squeeze bottle. Moisturizers or humectants can also be added to pharmaceutical compositions and dosage forms if desired. Examples of such additional ingredients are well known in the art.

If the method comprises intranasal administration of a composition, the composition can be formulated in an aerosol form, spray, mist or in the form of drops. In particular, prophylactic or therapeutic agents are provided and can be conveniently delivered in the form of an aerosol spray presentation from pressurized packs or a nebulizer, with the use of a suitable propellant (e.g., dichlorodifluoromethane, trichlorofluoromethane, dichlorotetrafluoroethane, carbon dioxide or other suitable gas). In the case of a pressurized aerosol the dosage unit may be determined by providing a valve to deliver a metered amount. Capsules and cartridges (composed of, e.g., gelatin) for use in an inhaler or insufflator may be formulated containing a powder mix of the compound and a suitable powder base such as lactose or starch.

If the method comprises oral administration, compositions can be formulated orally in the form of tablets, capsules, cachets, gelcaps, solutions, suspensions, and the like. Tablets or capsules can be prepared by conventional means with pharmaceutically acceptable excipients such as binding agents (e.g., pregelatinised maize starch, polyvinylpyrrolidone, or hydroxypropyl methylcellulose); fillers (e.g., lactose, microcrystalline cellulose, or calcium hydrogen phosphate); lubricants (e.g., magnesium stearate, talc, or silica); disintegrants (e.g., potato starch or sodium starch glycolate); or wetting agents (e.g., sodium lauryl sulphate). The tablets may be coated by methods well-known in the art. Liquid preparations for oral administration may take the form of, but not limited to, solutions, syrups or suspensions, or they may be presented as a dry product for constitution with water or other suitable vehicle before use. Such liquid preparations may be prepared by conventional means with pharmaceutically acceptable additives such as suspending agents (e.g., sorbitol syrup, cellulose derivatives, or hydrogenated edible fats); emulsifying agents (e.g., lecithin or acacia); non-aqueous vehicles (e.g., almond oil, oily esters, ethyl alcohol, or fractionated vegetable oils); and preservatives (e.g., methyl or propyl-p-hydroxybenzoates or sorbic acid). The preparations may also contain buffer salts, flavoring, coloring, and sweetening agents as appropriate. Preparations for oral administration may be suitably formulated for slow release, controlled release, or sustained release of a prophylactic or therapeutic agent(s).

The provided method may comprise pulmonary administration, e.g., by use of an inhaler or nebulizer, of a composition formulated with an aerosolizing agent. See, e.g., U.S. Pat. Nos. 6,019,968; 5,985,320; 5,985,309; 5,934,272; 5,874,064; 5,855,913; 5,290,540; and 4,880,078; and PCT Publication Nos. WO 92/19244, WO 97/32572, WO 97/44013, WO 98/31346, and WO 99/66903. A specific embodiment provides an antibody, combination therapy, and/or composition administered using Alkermes AIR® pulmonary drug delivery technology (Alkermes, Inc., Cambridge, Mass.).

The provided method may comprise administration of a composition formulated for parenteral administration by injection (e.g., by bolus injection or continuous infusion). Formulations for injection may be presented in unit dosage form (e.g., in ampoules or in multi-dose containers) with an added preservative. The compositions may take such forms as suspensions, solutions or emulsions in oily or aqueous vehicles, and may contain formulatory agents such as suspending, stabilizing and/or dispersing agents. Alternatively, the active ingredient may be in powder form for constitution with a suitable vehicle (e.g., sterile pyrogen-free water) before use.

The provided methods may additionally comprise of administration of compositions formulated as depot preparations. Such long acting formulations may be administered by implantation (e.g., subcutaneously or intramuscularly) or by intramuscular injection. Thus, for example, the compositions may be formulated with suitable polymeric or hydrophobic materials (e.g., as an emulsion in an acceptable oil) or ion exchange resins, or as sparingly soluble derivatives (e.g., as a sparingly soluble salt).

The provided methods encompass administration of compositions formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

Generally, the ingredients of compositions are supplied either separately or mixed together in unit dosage form, for example, as a dry lyophilized powder or water free concentrate in a hermetically sealed container such as an ampoule or sachet indicating the quantity of active agent. Where the mode of administration is infusion, composition can be dispensed with an infusion bottle containing sterile pharmaceutical grade water or saline. Where the mode of administration is by injection, an ampoule of sterile water for injection or saline can be provided so that the ingredients may be mixed prior to administration.

In particular, it is also provided that one or more of the prophylactic or therapeutic agents, or pharmaceutical compositions is packaged in a hermetically sealed container such as an ampoule or sachette indicating the quantity of the agent. One embodiment provides one or more of the prophylactic or therapeutic agents, or pharmaceutical compositions is supplied as a dry sterilized lyophilized powder or water free concentrate in a hermetically sealed container and can be reconstituted (e.g., with water or saline) to the appropriate concentration for administration to a subject. An embodiment provides one or more of the prophylactic or therapeutic agents or pharmaceutical compositions is supplied as a dry sterile lyophilized powder in a hermetically sealed container at a unit dosage of at least 5 mg, e.g., at least 10 mg, at least 15 mg, at least 25 mg, at least 35 mg, at least 45 mg, at least 50 mg, at least 75 mg, or at least 100 mg. The lyophilized prophylactic or therapeutic agents or pharmaceutical compositions should be stored at between 2° C. and 8° C. in its original container and the prophylactic or therapeutic agents, or pharmaceutical compositions should be administered within 1 week, e.g., within 5 days, within 72 hours, within 48 hours, within 24 hours, within 12 hours, within 6 hours, within 5 hours, within 3 hours, or within 1 hour after being reconstituted. An alternative embodiment provides one or more of the prophylactic or therapeutic agents or pharmaceutical compositions is supplied in liquid form in a hermetically sealed container indicating the quantity and concentration of the agent. In an embodiment, the liquid form of the administered composition is supplied in a hermetically sealed container at least 0.25 mg/ml, e.g., at least 0.5 mg/ml, at least 1 mg/ml, at least 2.5 mg/ml, at least 5 mg/ml, at least 8 mg/ml, at least 10 mg/ml, at least 15 mg/kg, at least 25 mg/ml, at least 50 mg/ml, at least 75 mg/ml or at least 100 mg/ml. The liquid form should be stored at between 2° C. and 8° C. in its original container.

Antibodies and antibody portions that can be incorporated into a pharmaceutical composition suitable for parenteral administration are provided. In an embodiment, the antibody or antibody-portions will be prepared as an injectable solution containing 0.1-250 mg/ml antibody. The injectable solution can be composed of either a liquid or lyophilized dosage form in a flint or amber vial, ampoule or pre-filled syringe. The buffer can be L-histidine (1-50 mM), optimally 5-10 mM, at pH 5.0 to 7.0 (optimally pH 6.0). Other suitable buffers include but are not limited to, sodium succinate, sodium citrate, sodium phosphate or potassium phosphate. Sodium chloride can be used to modify the toxicity of the solution at a concentration of 0-300 mM (optimally 150 mM for a liquid dosage form). Cryoprotectants can be included for a lyophilized dosage form, principally 0-10% sucrose (optimally 0.5-1.0%). Other suitable cryoprotectants include trehalose and lactose. Bulking agents can be included for a lyophilized dosage form, principally 1-10% mannitol (optimally 2-4%). Stabilizers can be used in both liquid and lyophilized dosage forms, principally 1-50 mM L-Methionine (optimally 5-10 mM). Other suitable bulking agents include glycine, arginine, can be included as 0-0.05% polysorbate-80 (optimally 0.005-0.01%). Additional surfactants include but are not limited to polysorbate 20 and BRIJ surfactants. The pharmaceutical composition comprising an antibody or antibody portion prepared as an injectable solution for parenteral administration is provided, and can further comprise an agent useful as an adjuvant, such as those used to increase the absorption, or dispersion of a therapeutic protein (e.g., antibody). A particularly useful adjuvant is hyaluronidase (such as Hylenex® recombinant human hyaluronidase). Addition of hyaluronidase in the injectable solution improves human bioavailability following parenteral administration, particularly subcutaneous administration. It also allows for greater injection site volumes (i.e. greater than 1 ml) with less pain and discomfort, and minimum incidence of injection site reactions (see, WO 2004/078140 and US patent application publication No. 2006104968).

The compositions provided may be in a variety of forms. These include, for example, liquid, semi-solid and solid dosage forms, such as liquid solutions (e.g., injectable and infusible solutions), dispersions or suspensions, tablets, pills, powders, liposomes and suppositories. An exemplary form depends on the intended mode of administration and therapeutic application. Typical compositions are in the form of injectable or infusible solutions, such as compositions similar to those used for passive immunization of humans with other antibodies. An exemplary mode of administration is parenteral (e.g., intravenous, subcutaneous, intraperitoneal, intramuscular). In an embodiment, the antibody is administered by intravenous infusion or injection. In another embodiment, the antibody is administered by intramuscular or subcutaneous injection.

Therapeutic compositions typically must be sterile and stable under the conditions of manufacture and storage. The composition can be formulated as a solution, microemulsion, dispersion, liposome, or other ordered structure suitable to high drug concentration. Sterile injectable solutions can be prepared by incorporating the active compound (I.e., antibody or antibody portion) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile, lyophilized powders for the preparation of sterile injectable solutions, exemplary methods of preparation are vacuum drying and spray-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including, in the composition, an agent that delays absorption, for example, monostearate salts and gelatin.

Antibodies and antibody-portions administered by a variety of methods known in the art are provided, although for many therapeutic applications, an exemplary route/mode of administration is subcutaneous injection, intravenous injection or infusion. As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., Sustained and Controlled Release Drug Delivery Systems, J. R. Robinson, ed., Marcel Dekker, Inc., New York, 1978.

In certain provided embodiments, an antibody or antibody portion may be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound by other than parenteral administration, it may be necessary to coat the compound with, or co-administer the compound with, a material to prevent its inactivation.

Supplementary active compounds can also be incorporated into the compositions. Embodiments provide an antibody or antibody portion coformulated with and/or coadministered with one or more additional therapeutic agents that are useful for treating disorders in which SOST activity is detrimental. For example, an anti-hSOST antibody or antibody portion may be coformulated and/or coadministered with one or more additional antibodies that bind other targets (e.g., antibodies that bind other cytokines or that bind cell surface molecules). Furthermore, one or more antibodies may be used in combination with two or more of the foregoing therapeutic agents. Such combination therapies may advantageously utilize lower dosages of the administered therapeutic agents, thus avoiding possible toxicities or complications associated with the various monotherapies.

In certain embodiments, an antibody to SOST or fragment thereof is linked to a half-life extending vehicle known in the art. Such vehicles include, but are not limited to, the Fc domain, polyethylene glycol, and dextran. Such vehicles are described, e.g., in U.S. Ser. No. 09/428,082 and published PCT Publication No. WO 99/25044.

In a specific embodiment, nucleic acid sequences comprising nucleotide sequences encoding an antibody of the invention or another prophylactic or therapeutic agent of the invention are administered to treat, prevent, manage, or ameliorate a disorder or one or more symptoms thereof by way of gene therapy are provided. Gene therapy refers to therapy performed by the administration to a subject of an expressed or expressible nucleic acid. In this provided embodiment, the nucleic acids produce their encoded antibody or prophylactic or therapeutic agent that mediates a prophylactic or therapeutic effect.

Any of the methods for gene therapy available in the art are provided. For general reviews of the methods of gene therapy, see Goldspiel et al., 1993, *Clinical Pharmacy*, 12: 488-505; Wu et al., "Delivery systems for gene therapy," *Biotherapy*, 3: 87-95 (1991); Tolstoshev, 1993, *Ann. Rev. Pharmacol. Toxicol.*, 32: 573-596; Mulligan, *Science*, 260: 926-932 (1993); and Morgan and Anderson, "Human Gene Therapy," *Ann. Rev. Biochem.*, 62:191-217 (1993); Robinson, C., *Trends Biotechnol.*, 11:155 (1993). Methods commonly known in the art of recombinant DNA technology which can be used are described in Ausubel et al. (eds.), Current Protocols in Molecular Biology, John Wiley &Sons, NY (1993); and Kriegler, Gene Transfer and Expression, A Laboratory Manual, Stockton Press, NY (1990). Detailed description of various methods of gene therapy are disclosed in US application publication No. US 2005/0042664.

Sclerostin plays a critical role in the pathology associated with a variety of diseases involving immune and inflammatory elements. These diseases include, but are not limited to, Acquired Immunodeficiency Disease Syndrome; Acquired Immunodeficiency Related Diseases; acquired pernicious anaemia; Acute coronary syndromes; acute and chronic pain (different forms of pain); Acute Idiopathic Polyneuritis; acute immune disease associated with organ transplantation; acute or chronic immune disease associated with organ transplantation; Acute Inflammatory Demyelinating Polyradiculoneuropathy; Acute ischemia; acute liver disease; acute rheumatic fever; acute transverse myelitis; Addison's disease; adult (acute) respiratory distress syndrome; Adult Still's Disease; alcoholic cirrhosis; alcohol-induced liver injury; allergic diseases; allergy; alopecia; Alopecia greata; Alzheimer's disease; Anaphylaxis; ankylosing spondylitis; ankylosing spondylitis associated lung disease; Anti-Phospholipid Antibody Syndrome; Aplastic anemia; Arteriosclerosis; arthropathy; asthma; atheromatous disease/arteriosclerosis; atherosclerosis; atopic allergy; Atopic eczema; Atopic dermatitis; atrophic autoimmune hypothyroidism; autoimmune bullous disease; Autoimmune dermatitis; autoimmune diabetes; Autoimmune disorder associated with *Streptococcus* infection; Autoimmune Enteropathy; autoimmune haemolytic anaemia; autoimmune hepatitis; Autoimmune hearing loss; Autoimmune Lymphoproliferative Syndrome (ALPS); autoimmune mediated hypoglycaemia; Autoimmune myocarditis; autoimmune neutropenia; Autoimmune premature ovarian failure; autoimmune thrombocytopenia (AITP); autoimmune thyroid disease; autoimmune uveitis; bronchiolitis obliterans; Behcet's disease; Blepharitis; Bronchiectasis; Bullous pemphigoid; cachexia; Cardiovascular Disease; Catastrophic Antiphospholipid Syndrome; Celiac Disease; Cervical Spondylosis; chlamydia; choleosatatis; chronic active hepatitis; chronic eosinophilic pneumonia; chronic fatigue syndrome; chronic immune disease associated with organ transplantation; Chronic ischemia; chronic liver diseases; chronic mucocutaneous candidiasis; Cicatricial pemphigoid; Clinically isolated Syndrome (CIS) with Risk for Multiple Sclerosis; common varied immunodeficiency (common variable hypogammaglobulinaemia); connective tissue disease associated interstitial lung disease; Conjunctivitis; Coombs positive haemolytic anaemia; Childhood Onset Psychiatric Disorder; Chronic obstructive pulmonary disease (COPD); Crohn's disease; cryptogenic autoimmune hepatitis; cryptogenic fibrosing alveolitis; Dacryocystitis; depression; dermatitis scleroderma; dermatomyositis; dermatomyositis/polymyositis associated lung disease; Diabetic retinopathy; Diabetes mellitus; dilated cardiomyopathy; discoid lupus erythematosus; Disk herniation; Disk prolapse; disseminated intravascular coagulation; Drug-Induced hepatitis; drug-induced interstitial lung disease; Drug induced immune hemolytic anemia; Endocarditis; Endometriosis; endophthalmitis; enteropathic synovitis; Episcleritis; Erythema multiforme; erythema multiforme major; female infertility; fibrosis; fibrotic lung disease; Gestational pemphigoid; giant cell arteritis (GCA); glomerulonephritides; goitrous autoimmune hypothyroidism (Hashimoto's disease); Goodpasture's syndrome; gouty arthritis; graft versus host disease (GVHD); Grave's disease; group B streptococci (GBS) infection; Guillain-Barrë Syndrome (GBS); haemosiderosis associated lung disease; Hay Fever; heart failure; hemolytic anemia; Henoch-Schoenlein purpurea; Hepatitis B; Hepatitis C; Hughes Syndrome; Huntington's chorea; hyperthyroidism; hypoparathyroidism; idiopathic leucopaenia; idiopathic thrombocytopaenia; Idiopathic Parkinson's Disease; idiopathic interstitial pneumonia; idiosyncratic liver disease; IgE-mediated Allergy; Immune hemolytic anemiae; Inclusion Body Myositis; infectious diseases; Infectious ocular inflammatory disease; inflammatory bowel disease; Inflammatory demyelinating disease; Inflammatory heart disease; Inflammatory kidney disease; insulin dependent diabetes mellitus; interstitial pneumonitis; IPF/UIP; Iritis; juvenile chronic arthritis; juvenile pernicious anaemia; Juvenile rheumatoid arthritis; Kawasaki's diseasee; Keratitis; Keratojunctivitis sicca; Kussmaul disease or Kussmaul-Meier Disease; Landry's Paralysis; Langerhan's Cell Histiocytosis; linear IgA disease; Livedo reticularis; Lyme arthritis; lymphocytic infiltrative lung disease; Macular Degeneration; male infertility idiopathic or NOS; malignancies; microscopic vasculitis of the kidneys; Microscopic Polyangiitis; mixed connective tissue disease associated lung disease; Morbus Bechterev; Motor Neuron Disorders; Mucous membrane pemphigoid; multiple sclerosis (all subtypes: primary progressive, secondary progressive, relapsing remitting etc.); Multiple Organ failure; myalgic encephalitis/Royal Free Disease; Myasthenia Gravis; Myelodysplastic Syndrome; myocardial infarction; Myocarditis; nephrotic syndrome; Nerve Root Disorders; Neuropathy; Non-alcoholic Steatohepatitis; Non-A Non-B Hepatitis; Optic Neuritis; organ transplant rejection; osteoarthritis; Osteolysis; Ovarian cancer; ovarian failure; Pancreatitis; Parasitic diseases; Parkinson's disease; Pauciarticular JRA; pemphigoid; pemphigus foliaceus; pemphigus vulgaris; peripheral artery occlusive disease (PAOD); peripheral vascular disease (PVD); peripheral artery disease (PAD); phacogenic uveitis; Phlebitis; Polyarteritis nodosa (or periarteritis nodosa); Polychondritis; Polymyalgia Rheumatica; Poliosis; Polyarticular JRA; Polyendocrine Deficiency Syndrome; Polymyositis; polyglandular deficiency type I and polyglandular deficiency type II; polymyalgia rheumatica (PMR); postinfectious interstitial lung disease; post-inflammatory interstitial lung disease; Post-Pump Syndrome; premature ovarian failure; primary biliary cirrhosis; primary myxoedema; primary parkinsonism; primary sclerosing cholangitis; primary sclerosing hepatitis; primary vasculitis; prostate and rectal cancer and hematopoietic malignancies (leukemia and lymphoma); Prostatitis; psoriasis; psoriasis type 1; psoriasis type 2; psoriatic arthritis; psoriatic arthropathy; pulmonary hypertension secondary to connective tissue disease; pulmonary manifestation of polyarteritis nodosa; Pure red cell aplasia; Primary Adrenal Insufficiency; radiation fibrosis; reactive arthritis; Reiter's disease; Recurrent Neuromyelitis Optica; renal disease NOS; Restenosis; rheumatoid arthritis; rheumatoid arthritis associated interstitial lung disease; Rheumatic heart disease; SAPHO (synovitis, acne, pustulosis, hyperostosis, and osteitis); sarcoidosis; Schizophreniae; Schmidt's syndrome; Scleroderma; Secondary Amyloidosis; Shock lung; Scleritis; Sciatica; Secondary Adrenal Insufficiency; sepsis syndrome; septic arthritis; septic shock; seronegative arthropathy; Silicone associated connective tissue disease; Sjögren's disease associated lung disease; Sjörgren's syndrome; Sneddon-Wilkinson Dermatosis; sperm autoimmunity; spondyloarthropathy; spondylitis ankylosans; Stevens-Johnson Syndrome (SJS); Still's disease; stroke; sympathetic ophthalmia; Systemic inflammatory response syndrome; systemic lupus erythematosus; systemic lupus erythematosus associated lung disease; systemic sclerosis; systemic sclerosis associated interstitial lung disease; Takayasu's disease/arteritis; Temporal arteritis; Th2 Type and Th1 Type mediated diseases; thyroiditis; toxic shock syndrome; toxoplasmic retinitis; toxic epidermal necrolysis; Transverse myelitis; TRAPS (Tumor-necrosis factor receptor type 1 (TNFR)-Associated Periodic Syndrome); type B insulin resistance with acanthosis nigricans; Type 1 allergic reaction; type-1 autoimmune hepatitis (classical autoimmune or lupoid hepatitis); type-2 autoimmune hepatitis (anti-LKM antibody hepatitis)e; Type II Diabetes; ulcerative colitic arthropathy; ulcerative colitis; Urticaria; Usual interstitial pneumonia (UIP); uveitis; vasculitic diffuse lung disease; Vasculitis; Vernal conjunctivitis; viral retinitis; vitiligo; Vogt-Koyanagi-Harada syndrome (VKH syndrome); Wegener's granulomatosis; Wet macular degeneration; Wound healing; or yersinia and salmonella associated arthropathy.

The antibodies and antibody portions can be used to treat humans suffering from autoimmune diseases, in particular those associated with inflammation, rheumatoid arthritis (RA), osteoarthritis, psoriasis, multiple sclerosis (MS), and other autoimmune diseases.

An antibody or antibody portion also can be administered with one or more additional therapeutic agents useful in the treatment of autoimmune and inflammatory diseases.

In a provided embodiment, diseases that can be treated or diagnosed with the compositions and methods include, but are not limited to, primary and metastatic cancers, including carcinomas of breast, colon, rectum, lung, oropharynx, hypopharynx, esophagus, stomach, pancreas, liver, gallbladder and bile ducts, small intestine, urinary tract (including kidney, bladder and urothelium), female genital tract (including cervix, uterus, and ovaries as well as choriocarcinoma and gestational trophoblastic disease), male genital tract (including prostate, seminal vesicles, testes and germ cell tumors), endocrine glands (including the thyroid, adrenal, and pituitary glands), and skin, as well as hemangiomas, melanomas, sarcomas (including those arising from bone and soft tissues as well as Kaposi's sarcoma), tumors of the brain, nerves, eyes, and meninges (including astrocytomas, gliomas, glioblastomas, retinoblastomas, neuromas, neuroblastomas, Schwannomas, and meningiomas), solid tumors arising from hematopoietic malignancies such as leukemias, and lymphomas (both Hodgkin's and non-Hodgkin's lymphomas).

In another embodiment, an antibody or antigen binding portion thereof used to treat cancer or in the prevention of metastases from a tumor is provided. Such treatment may involve administration of the antibody or antigen binding portion thereof alone or in combination with another therapeutic agent or treatment, such as radiotherapy and/or a chemotherapeutic agent.

Antibodies or antigen binding portions thereof are provided that may be combined with agents that include but are not limited to, antineoplastic agents, radiotherapy, chemotherapy such as DNA alkylating agents, cisplatin, carboplatin, anti-tubulin agents, paclitaxel, docetaxel, taxol, doxorubicin, gemcitabine, gemzar, anthracyclines, adriamycin, topoisomerase I inhibitors, topoisomerase II inhibitors, 5-fluorouracil (5-FU), leucovorin, irinotecan, receptor tyrosine kinase inhibitors (e.g., erlotinib, gefitinib), COX-2 inhibitors (e.g., celecoxib), kinase inhibitors, and siRNAs.

A binding protein administered with one or more additional therapeutic agents useful in the treatment of various diseases is also provided.

Antibodies or antigen binding portions thereof that can be used alone or in combination to treat such diseases are provided. It should be understood that the antibodies or antigen binding portion thereof can be used alone or in combination with an additional agent, e.g., a therapeutic agent, said additional agent being selected by the skilled artisan for its intended purpose. For example, the additional agent can be a therapeutic agent art-recognized as being useful to treat the disease or condition being treated by the antibody. The additional agent also can be an agent that imparts a beneficial attribute to the therapeutic composition, e.g., an agent that affects the viscosity of the composition.

It should further be understood that the combinations which are to be included are those combinations useful for their intended purpose. The agents set forth below are illustrative for purposes and not intended to be limited. The combinations can be the antibodies and at least one additional agent selected from the lists below. The combination can also include more than one additional agent, e.g., two or three additional agents if the combination is such that the formed composition can perform its intended function.

Exemplary combinations are non-steroidal anti-inflammatory drug(s) also referred to as NSAIDS which include drugs like ibuprofen. Other exemplary combinations are corticosteroids including prednisolone; the well known side-effects of steroid use can be reduced or even eliminated by tapering the steroid dose required when treating patients in combination with the anti-sclerostin antibodies. Non-limiting examples of therapeutic agents for rheumatoid arthritis with which an antibody or antibody portion can be combined are provided and include, but are not limited to, the following:

cytokine suppressive anti-inflammatory drug(s) (CSAIDs); antibodies to or antagonists of other human cytokines or growth factors, for example, TNF, LT, IL-1, IL-2, IL-3, IL-4, IL-5, IL-6, IL-7, IL-8, IL-15, IL-16, IL-18, IL-21, interferons, EMAP-II, GM-CSF, FGF, and PDGF. Antibodies or antigen binding portions thereof, can be combined with antibodies to cell surface molecules such as CD2, CD3, CD4, CD8, CD25, CD28, CD30, CD40, CD45, CD69, CD80 (B7.1), CD86 (B7.2), CD90, CTLA or their ligands including CD154 (39 or CD40L).

Exemplary combinations of therapeutic agents may interfere at different points in the autoimmune and subsequent inflammatory cascade; exemplary examples include TNF antagonists like chimeric, humanized or human TNF antibodies, D2E7, (PCT Publication No. WO 97/29131), CA2 (Remicade™), CDP 571, and soluble p55 or p75 TNF receptors, derivatives, thereof, (p75TNFR1gG (Enbrel™) or p55TNFR1gG (Lenercept), and also TNFα converting enzyme (TACE) inhibitors; similarly IL-1 inhibitors (Interleukin-1-converting enzyme inhibitors, IL-1RA etc.) may be effective for the same reason. Other exemplary combinations include Interleukin 11. Yet another exemplary combination are other key players of the autoimmune response which may act parallel to, dependent on or in concert with SOST function. Yet another exemplary combination are non-depleting anti-CD4 inhibitors. Yet other exemplary combinations include antagonists of the co-stimulatory pathway CD80 (B7.1) or CD86 (B7.2) including antibodies, soluble receptors or antagonistic ligands.

The antibodies or antigen binding portions thereof, may also be combined with agents, such as methotrexate, 6-MP, azathioprine sulphasalazine, mesalazine, olsalazine chloroquinine/hydroxychloroquine, pencillamine, aurothiomalate (intramuscular and oral), azathioprine, colchicine, corticosteroids (oral, inhaled and local injection), beta-2 adrenoreceptor agonists (salbutamol, terbutaline, salmeteral), xanthines (theophylline, aminophylline), cromoglycate, nedocromil, ketotifen, ipratropium and oxitropium, cyclosporin, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signaling by proinflammatory cytokines such as TNF-α or IL-1 (e.g., IRAK, NIK, IKK, p38, or MAP kinase inhibitors), IL-1β converting enzyme inhibitors, TNFaconverting enzyme (TACE) inhibitors, T-cell signaling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g. soluble p55 or p75 TNF receptors and the derivatives p75TNFRIgG (Enbrel™ and p55TNFRIgG (Lenercept)), sIL-1R1, sIL-1RII, sIL-6R), antiinflammatory cytokines (e.g. IL-4, IL-10, IL-11, IL-13 and TGFβ), celecoxib, folic acid, hydroxychloroquine sulfate, rofecoxib, etanercept, infliximab, naproxen, valdecoxib, sulfasalazine, methylprednisolone, meloxicam, methylprednisolone acetate, gold sodium thiomalate, aspirin, triamcinolone acetonide, propoxyphene napsylate/apap, folate, nabumetone, diclofenac, piroxicam, etodolac, diclofenac sodium, oxaprozin, oxycodone hcl, hydrocodone bitartrate/apap, diclofenac sodium/misoprostol, fentanyl, anakinra, human recombinant, tramadol hcl, salsalate, sulindac, cyanocobalamin/fa/pyridoxine, acetaminophen, alendronate sodium, prednisolone, morphine sulfate, lidocaine hydrochloride, indomethacin, glucosamine sulf/chondroitin, amitriptyline hcl, sulfadiazine, oxycodone hcl/acetaminophen, olopatadine hcl, misoprostol, naproxen sodium, omeprazole, cyclophosphamide, rituximab, IL-1 TRAP, MRA, CTLA4-IG, IL-18 BP, anti-IL-18, Anti-IL15, BIRB-796, SCIO-469, VX-702, AMG-548, VX-740, Roflumilast, IC-485, CDC-801, and Mesopram. Exemplary combinations include methotrexate or leflunomide and in moderate or severe rheumatoid arthritis cases, cyclosporine.

Non-limiting additional agents which can also be used in combination with a binding protein to treat rheumatoid arthritis (RA) include, but are not limited to, the following: non-steroidal anti-inflammatory drug(s) (NSAIDs); cytokine suppressive anti-inflammatory drug(s) (CSAIDs); CDP-571/BAY-10-3356 (humanized anti-TNFα antibody; Celltech/Bayer); cA2/infliximab (chimeric anti-TNFα antibody; Centocor); 75 kdTNFR-IgG/etanercept (75 kD TNF receptor-IgG fusion protein; Immunex; see e.g., *Arthritis & Rheumatism* (1994) Vol. 37, S295; *J. Invest. Med.* (1996) Vol. 44, 235A); 55 kdTNF-IgG (55 kD TNF receptor-IgG fusion protein; Hoffmann-LaRoche); IDEC-CE9.1/SB 210396 (non-depleting primatized anti-CD4 antibody; IDEC/SmithKline; see e.g., *Arthritis & Rheumatism* (1995) Vol. 38, S185); DAB 486-IL-2 and/or DAB 389-IL-2 (IL-2 fusion proteins; Seragen; see e.g., *Arthritis & Rheumatism* (1993) Vol. 36, 1223); Anti-Tac (humanized anti-IL-2Rα; Protein Design Labs/Roche); IL-4 (anti-inflammatory cytokine; DNAX/Schering); IL-10 (SCH 52000; recombinant IL-10, anti-inflammatory cytokine; DNAX/Schering); IL-4; IL-10 and/or IL-4 agonists (e.g., agonist antibodies); IL-1RA (IL-1 receptor antagonist; Synergen/Amgen); anakinra (Kineret®/Amgen); TNF-bp/s-TNF (soluble TNF binding protein; see e.g., *Arthritis & Rheumatism* (1996) Vol. 39, No. 9 (supplement), 5284; *Amer. J. Physiol.-Heart and Circulatory Physiology* (1995) Vol. 268, pp. 37-42); R973401 (phosphodiesterase Type IV inhibitor; see e.g., *Arthritis & Rheumatism* (1996) Vol. 39, No. 9 (supplement), S282); MK-966 (COX-2 Inhibitor; see e.g., *Arthritis & Rheumatism* (1996) Vol. 39, No. 9 (supplement), S81); Iloprost (see e.g., *Arthritis & Rheumatism* (1996) Vol. 39, No. 9 (supplement), S82); methotrexate; thalidomide (see e.g., *Arthritis & Rheumatism* (1996) Vol. 39, No. 9 (supplement), 5282) and thalidomide-related drugs (e.g., Celgen); leflunomide (anti-inflammatory and cytokine inhibitor; see e.g., *Arthritis & Rheumatism* (1996) Vol. 39, No. 9 (supplement), S131; *Inflammation Research* (1996) Vol. 45, pp. 103-107); tranexamic acid (inhibitor of plasminogen activation; see e.g., *Arthritis & Rheumatism* (1996) Vol. 39, No. 9 (supplement), S284); T-614 (cytokine inhibitor; see e.g., *Arthritis & Rheumatism* (1996) Vol. 39, No. 9 (supplement), S282); prostaglandin E1 (see e.g., *Arthritis & Rheumatism* (1996) Vol. 39, No. 9 (supplement), S282); Tenidap (non-steroidal anti-inflammatory drug; see e.g., *Arthritis & Rheumatism* (1996) Vol. 39, No. 9 (supplement), S280); Naproxen (non-steroidal anti-inflammatory drug; see e.g., *Neuro Report* (1996) Vol. 7, pp. 1209-1213); Meloxicam (non-steroidal anti-inflammatory drug); Ibuprofen (non-steroidal anti-inflammatory drug); Piroxicam (non-steroidal anti-inflammatory drug); Diclofenac (non-steroidal anti-inflammatory drug); Indomethacin (non-steroidal anti-inflammatory drug); Sulfasalazine (see e.g., *Arthritis & Rheumatism* (1996) Vol. 39, No. 9 (supplement), S281); Azathioprine (see e.g., *Arthritis & Rheumatism* (1996) Vol. 39, No. 9 (supplement), S281); ICE inhibitor (inhibitor of the enzyme interleukin-1β converting enzyme); zap-70 and/or lck inhibitor (inhibitor of the tyrosine kinase zap-70 or lck); VEGF inhibitor and/or VEGF-R inhibitor (inhibitors of vascular endothelial cell growth factor or vascular endothelial cell growth factor receptor; inhibitors of angiogenesis); corticosteroid anti-inflammatory drugs (e.g., 5B203580); TNF-convertase inhibitors; anti-IL-12 antibodies; anti-IL-18 antibodies; interleukin-11 (see e.g., *Arthritis & Rheumatism* (1996) Vol. 39, No. 9 (supplement), S296); interleukin-13 (see e.g., *Arthritis & Rheumatism* (1996) Vol. 39, No. 9 (supplement), S308); interleukin-17 inhibitors (see e.g., *Arthritis & Rheumatism* (1996) Vol. 39, No. 9 (supplement), S120); gold; penicillamine; chloroquine; chlorambucil; hydroxychloroquine; cyclosporine; cyclophosphamide; total lymphoid irradiation; anti-thymocyte globulin; anti-CD4 antibodies; CD5-toxins; orally-administered peptides and collagen; lobenzarit disodium; Cytokine Regulating Agents (CRAs) HP228 and HP466 (Houghten Pharmaceuticals, Inc.); ICAM-1 antisense phosphorothioate oligo-deoxynucleotides (ISIS 2302; Isis Pharmaceuticals, Inc.); soluble complement receptor 1 (TP10; T Cell Sciences, Inc.); prednisone; orgotein; glycosaminoglycan polysulphate; minocycline; anti-IL2R antibodies; marine and botanical lipids (fish and plant seed fatty acids; see e.g., DeLuca et al. (1995) *Rheum. Dis. Clin. North Am.,* 21: 759-777); auranofin; phenylbutazone; meclofenamic acid; flufenamic acid; intravenous immune globulin; zileuton; azaribine; mycophenolic acid (RS-61443); tacrolimus (FK-506); sirolimus (rapamycin); amiprilose (therafectin); cladribine (2-chlorodeoxyadenosine); methotrexate; bcl-2 inhibitors (see Bruncko, Milan et al., Journal of Medicinal Chemistry (2007), 50(4), 641-662); antivirals and immune modulating agents.

In one embodiment, the binding protein or antigen-binding portion thereof, is administered in combination with one of the following agents for the treatment of rheumatoid arthritis (RA): small molecule inhibitor of KDR, small molecule inhibitor of Tie-2; methotrexate; prednisone; celecoxib; folic acid; hydroxychloroquine sulfate; rofecoxib; etanercept; infliximab; leflunomide; naproxen; valdecoxib; sulfasalazine; methylprednisolone; ibuprofen; meloxicam; methylprednisolone acetate; gold sodium thiomalate; aspirin; azathioprine; triamcinolone acetonide; propoxyphene napsylate/apap; folate; nabumetone; diclofenac; piroxicam; etodolac; diclofenac sodium; oxaprozin; oxycodone hcl; hydrocodone bitartrate/apap; diclofenac sodium/misoprostol; fentanyl; anakinra, human recombinant; tramadol hcl; salsalate; sulindac; cyanocobalamin/fa/pyridoxine; acetaminophen; alendronate sodium; prednisolone; morphine sulfate; lidocaine hydrochloride; indomethacin; glucosamine sulfate/chondroitin; cyclosporine; amitriptyline hcl; sulfadiazine; oxycodone hcl/acetaminophen; olopatadine hcl; misoprostol; naproxen sodium; omeprazole; mycophenolate mofetil; cyclophosphamide; rituximab; IL-1 TRAP; MRA; CTLA4-IG; IL-18 BP; IL-12/23; anti-IL 18; anti-IL 15; BIRB-796; SC10-469; VX-702; AMG-548; VX-740; Roflumilast; IC-485; CDC-801; and mesopram.

Non-limiting examples of therapeutic agents for inflammatory bowel disease with which a binding protein can be combined include the following: budenoside; epidermal growth factor; corticosteroids; cyclosporin, sulfasalazine; aminosalicylates; 6-mercaptopurine; azathioprine; metronidazole; lipoxygenase inhibitors; mesalamine; olsalazine; balsalazide; antioxidants; thromboxane inhibitors; IL-1 receptor antagonists; anti-IL-1β mAbs; anti-IL-6 mAbs; growth factors; elastase inhibitors; pyridinyl-imidazole compounds; antibodies to or antagonists of other human cytokines or growth factors, for example, TNF, LT, IL-1, IL-2, IL-6, IL-7, IL-8, IL-15, IL-16, IL-17, IL-18, EMAP-II, GM-CSF, FGF, and PDGF. Antibodies or antigen binding portions thereof, can be combined with antibodies to cell surface molecules such as CD2, CD3, CD4, CD8, CD25, CD28, CD30, CD40, CD45, CD69, CD90 or their ligands. The antibodies or antigen binding portions thereof, may also be combined with agents, such as methotrexate, cyclosporin, FK506, rapamycin, mycophenolate mofetil, leflunomide, NSAIDs, for example, ibuprofen, corticosteroids such as prednisolone, phosphodiesterase inhibitors, adenosine agonists, antithrombotic agents, complement inhibitors, adrenergic agents, agents which interfere with signaling by proinflammatory cytokines such as TNFα or IL-1 (e.g., IRAK, NIK, IKK, p38 or MAP kinase inhibitors), IL-1β converting enzyme inhibitors, TNFα converting enzyme inhibitors, T-cell signaling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors, sIL-1RI, sIL-1RII, sIL-6R) and antiinflammatory cytokines (e.g., IL-4, IL-10, IL-11, IL-13 and TGFβ) and bcl-2 inhibitors.

Examples of therapeutic agents for Crohn's disease in which a binding protein can be combined include the following: TNF antagonists, for example, anti-TNF antibodies, Adalimumab (PCT Publication No. WO 97/29131; HUMIRA®), CA2 (REMICADE), CDP 571, TNFR-Ig constructs, (p75TNFRIgG (ENBREL®) and p55TNFRIgG (LENERCEPT™)) inhibitors and PDE4 inhibitors. Antibodies or antigen binding portions thereof, can be combined with corticosteroids, for example, budenoside and dexamethasone. Binding proteins or antigen binding portions thereof, may also be combined with agents such as sulfasalazine, 5-aminosalicylic acid and olsalazine, and agents which interfere with synthesis or action of proinflammatory cytokines such as IL-1, for example, IL-1β converting enzyme inhibitors and IL-1ra. Antibodies or antigen binding portion thereof may also be used with T cell signaling inhibitors, for example, tyrosine kinase inhibitors 6-mercaptopurines. Binding proteins or antigen binding portions thereof, can be combined with IL-11. Binding proteins or antigen binding portions thereof, can be combined with mesalamine, prednisone, azathioprine, mercaptopurine, infliximab, methylprednisolone sodium succinate, diphenoxylate/atrop sulfate, loperamide hydrochloride, methotrexate, omeprazole, folate, ciprofloxacin/dextrose-water, hydrocodone bitartrate/apap, tetracycline hydrochloride, fluocinonide, metronidazole, thimerosal/boric acid, cholestyramine/sucrose, ciprofloxacin hydrochloride, hyoscyamine sulfate, meperidine hydrochloride, midazolam hydrochloride, oxycodone hcl/acetaminophen, promethazine hydrochloride, sodium phosphate, sulfamethoxazole/trimethoprim, celecoxib, polycarbophil, propoxyphene napsylate, hydrocortisone, multivitamins, balsalazide disodium, codeine phosphate/apap, colesevelam hcl, cyanocobalamin, folic acid, levofloxacin, methylprednisolone, natalizumab and interferon-gamma Non-limiting examples of therapeutic agents for multiple sclerosis (MS) with which binding proteins can be combined include the following: corticosteroids; prednisolone; methylprednisolone; azathioprine; cyclophosphamide; cyclosporine; methotrexate; 4-aminopyridine; tizanidine; interferon-β1a (AVONEX; Biogen); interferon-β1b (BETASERON; Chiron/Berlex); interferon α-n3) (Interferon Sciences/Fujimoto), interferon-α (Alfa Wassermann/J&J), interferon β1A-IF (Serono/Inhale Therapeutics), Peginterferon α 2b (Enzon/Schering-Plough), Copolymer 1 (Cop-1; COPAXONE; Teva Pharmaceutical Industries, Inc.); hyperbaric oxygen; intravenous immunoglobulin; clabribine; antibodies to or antagonists of other human cytokines or growth factors and their receptors, for example, TNF, LT, IL-1, IL-2, IL-6, IL-7, IL-8, IL-23, IL-15, IL-16, IL-18, EMAP-II, GM-CSF, FGF, and PDGF. Binding proteins can be combined with antibodies to cell surface molecules such as CD2, CD3, CD4, CD8, CD19, CD20, CD25, CD28, CD30, CD40, CD45, CD69, CD80, CD86, CD90 or their ligands. Binding proteins may also be combined with agents, such as methotrexate, cyclosporine, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signaling by proinflammatory cytokines such as TNFα or IL-1 (e.g., IRAK, NIK, IKK, p38 or MAP kinase inhibitors), IL-1β converting enzyme inhibitors, TACE inhibitors, T-cell signaling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors, sIL-1R1, sIL-1RII, sIL-6R), antiinflammatory cytokines (e.g., IL-4, IL-10, IL-13 and TGFβ) and bcl-2 inhibitors.

Examples of therapeutic agents for multiple sclerosis in which binding proteins can be combined include interferon-β, for example, IFNβ1a and IFNβ1b; copaxone, corticosteroids, caspase inhibitors, for example inhibitors of caspase-1, IL-1 inhibitors, TNF inhibitors, and antibodies to CD40 ligand and CD80.

The binding proteins may also be combined with agents, such as alemtuzumab, dronabinol, Unimed, daclizumab, mitoxantrone, xaliproden hydrochloride, fampridine, glatiramer acetate, natalizumab, sinnabidol, a-immunokine NNSO3, ABR-215062, AnergiX.MS, chemokine receptor antagonists, BBR-2778, calagualine, CPI-1189, LEM (liposome encapsulated mitoxantrone), THC.CBD (cannabinoid agonist) MBP-8298, mesopram (PDE4 inhibitor), MNA-715, anti-IL-6 receptor antibody, neurovax, pirfenidone allotrap 1258 (RDP-1258), sTNF-R1, talampanel, teriflunomide, TGF-beta2, tiplimotide, VLA-4 antagonists (for example, TR-14035, VLA4 Ultrahaler, Antegran-ELAN/Biogen), interferon gamma antagonists, IL-4 agonists.

Non-limiting examples of therapeutic agents for Angina with which binding proteins can be combined are provided and include the following: aspirin, nitroglycerin, isosorbide mononitrate, metoprolol succinate, atenolol, metoprolol tartrate, amlodipine besylate, diltiazem hydrochloride, isosorbide dinitrate, clopidogrel bisulfate, nifedipine, atorvastatin calcium, potassium chloride, furosemide, simvastatin, verapamil hcl, digoxin, propranolol hydrochloride, carvedilol, lisinopril, spironolactone, hydrochlorothiazide, enalapril maleate, nadolol, ramipril, enoxaparin sodium, heparin sodium, valsartan, sotalol hydrochloride, fenofibrate, ezetimibe, bumetanide, losartan potassium, lisinopril/hydrochlorothiazide, felodipine, captopril, bisoprolol fumarate.

Non-limiting examples of therapeutic agents for Ankylosing Spondylitis with which binding proteins can be combined are provided and include the following: ibuprofen, diclofenac and misoprostol, naproxen, meloxicam, indomethacin, diclofenac, celecoxib, rofecoxib, Sulfasalazine, Methotrexate, azathioprine, minocyclin, prednisone, etanercept, infliximab.

Non-limiting examples of therapeutic agents for Asthma with which binding proteins can be combined are provided and include the following: albuterol, salmeterol/fluticasone, montelukast sodium, fluticasone propionate, budesonide, prednisone, salmeterol xinafoate, levalbuterol hcl, albuterol sulfate/ipratropium, prednisolone sodium phosphate, triamcinolone acetonide, beclomethasone dipropionate, ipratropium bromide, azithromycin, pirbuterol acetate, prednisolone, theophylline anhydrous, methylprednisolone sodium succinate, clarithromycin, zafirlukast, formoterol fumarate, influenza virus vaccine, methylprednisolone, amoxicillin trihydrate, flunisolide, allergy injection, cromolyn sodium, fexofenadine hydrochloride, flunisolide/menthol, amoxicillin/clavulanate, levofloxacin, inhaler assist device, guaifenesin, dexamethasone sodium phosphate, moxifloxacin hcl, doxycycline hyclate, guaifenesin/d-methorphan, p-ephedrine/cod/chlorphenir, gatifloxacin, cetirizine hydrochloride, mometasone furoate, salmeterol xinafoate, benzonatate, cephalexin, pe/hydrocodone/chlorphenir, cetirizine hcl/pseudoephed, phenylephrine/cod/promethazine, codeine/promethazine, cefprozil, dexamethasone, guaifenesin/pseudoephedrine, chlorpheniramine/hydrocodone, nedocromil sodium, terbutaline sulfate, epinephrine, methylprednisolone, metaproterenol sulfate.

Non-limiting examples of therapeutic agents for COPD with which binding proteins can be combined are provided and include the following: albuterol sulfate/ipratropium, ipratropium bromide, salmeterol/fluticasone, albuterol, salmeterol xinafoate, fluticasone propionate, prednisone, theophylline anhydrous, methylprednisolone sodium succinate, montelukast sodium, budesonide, formoterol fumarate, triamcinolone acetonide, levofloxacin, guaifenesin, azithromycin, beclomethasone dipropionate, levalbuterol hcl, flunisolide, ceftriaxone sodium, amoxicillin trihydrate, gatifloxacin, zafirlukast, amoxicillin/clavulanate, flunisolide/menthol, chlorpheniramine/hydrocodone, metaproterenol sulfate, methylprednisolone, mometasone furoate, p-ephedrine/cod/chlorphenir, pirbuterol acetate, p-ephedrine/loratadine, terbutaline sulfate, tiotropium bromide, (R,R)-formoterol, TgAAT, Cilomilast, Roflumilast.

Non-limiting examples of therapeutic agents for HCV with which binding proteins can be combined are provided and include the following: Interferon-alpha-2a, Interferon-alpha-2b, Interferon-alpha coni, Interferon-alpha-n1, Pegylated interferon-alpha-2a, Pegylated interferon-alpha-2b, ribavirin, Peginterferon alfa-2b+ribavirin, Ursodeoxycholic Acid, Glycyrrhizic Acid, Thymalfasin, Maxamine, VX-497 and any compounds that are used to treat HCV through intervention with the following targets: HCV polymerase, HCV protease, HCV helicase, HCV IRES (internal ribosome entry site).

Non-limiting examples of therapeutic agents for Idiopathic Pulmonary Fibrosis with which binding proteins can be combined are provided and include the following: prednisone, azathioprine, albuterol, colchicine, albuterol sulfate, digoxin, gamma interferon, methylprednisolone sod succ, lorazepam, furosemide, lisinopril, nitroglycerin, spironolactone, cyclophosphamide, ipratropium bromide, actinomycin d, alteplase, fluticasone propionate, levofloxacin, metaproterenol sulfate, morphine sulfate, oxycodone hcl, potassium chloride, triamcinolone acetonide, tacrolimus anhydrous, calcium, interferon-alpha, methotrexate, mycophenolate mofetil, Interferon-gamma-1β.

Non-limiting examples of therapeutic agents for Myocardial Infarction with which binding proteins can be combined are provided and include the following: aspirin, nitroglycerin, metoprolol tartrate, enoxaparin sodium, heparin sodium, clopidogrel bisulfate, carvedilol, atenolol, morphine sulfate, metoprolol succinate, warfarin sodium, lisinopril, isosorbide mononitrate, digoxin, furosemide, simvastatin, ramipril, tenecteplase, enalapril maleate, torsemide, retavase, losartan potassium, quinapril hcl/mag carb, bumetanide, alteplase, enalaprilat, amiodarone hydrochloride, tirofiban hcl m-hydrate, diltiazem hydrochloride, captopril, irbesartan, valsartan, propranolol hydrochloride, fosinopril sodium, lidocaine hydrochloride, eptifibatide, cefazolin sodium, atropine sulfate, aminocaproic acid, spironolactone, interferon, sotalol hydrochloride, potassium chloride, docusate sodium, dobutamine hcl, alprazolam, pravastatin sodium, atorvastatin calcium, midazolam hydrochloride, meperidine hydrochloride, isosorbide dinitrate, epinephrine, dopamine hydrochloride, bivalirudin, rosuvastatin, ezetimibe/simvastatin, avasimibe, cariporide.

Non-limiting examples of therapeutic agents for Psoriasis with which binding proteins can be combined are provided and include the following: small molecule inhibitor of KDR, small molecule inhibitor of Tie-2, calcipotriene, clobetasol propionate, triamcinolone acetonide, halobetasol propionate, tazarotene, methotrexate, fluocinonide, betamethasone diprop augmented, fluocinolone acetonide, acitretin, tar shampoo, betamethasone valerate, mometasone furoate, ketoconazole, pramoxine/fluocinolone, hydrocortisone valerate, flurandrenolide, urea, betamethasone, clobetasol propionate/emoll, fluticasone propionate, azithromycin, hydrocortisone, moisturizing formula, folic acid, desonide, pimecrolimus, coal tar, diflorasone diacetate, etanercept folate, lactic acid, methoxsalen, hc/bismuth subgal/znox/resor, methylprednisolone acetate, prednisone, sunscreen, halcinonide, salicylic acid, anthralin, clocortolone pivalate, coal extract, coal tar/salicylic acid, coal tar/salicylic acid/sulfur, desoximetasone, diazepam, emollient, fluocinonide/emollient, mineral oil/castor oil/na lact, mineral oil/peanut oil, petroleum/isopropyl myristate, psoralen, salicylic acid, soap/ tribromsalan, thimerosal/boric acid, celecoxib, infliximab, cyclosporine, alefacept, efalizumab, tacrolimus, pimecrolimus, PUVA, UVB, sulfasalazine.

Non-limiting examples of therapeutic agents for Psoriatic Arthritis with which binding proteins can be combined are provided and include the following: methotrexate, etanercept, rofecoxib, celecoxib, folic acid, sulfasalazine, naproxen, leflunomide, methylprednisolone acetate, indomethacin, hydroxychloroquine sulfate, prednisone, sulindac, betamethasone diprop augmented, infliximab, methotrexate, folate, triamcinolone acetonide, diclofenac, dimethylsulfoxide, piroxicam, diclofenac sodium, ketoprofen, meloxicam, methylprednisolone, nabumetone, tolmetin sodium, calcipotriene, cyclosporine, diclofenac sodium/misoprostol, fluocinonide, glucosamine sulfate, gold sodium thiomalate, hydrocodone bitartrate/apap, ibuprofen, risedronate sodium, sulfadiazine, thioguanine, valdecoxib, alefacept, efalizumab and bcl-2 inhibitors.

Non-limiting examples of therapeutic agents for Restenosis with which binding proteins can be combined are provided and include the following: sirolimus, paclitaxel, everolimus, tacrolimus, Zotarolimus, acetaminophen.

Non-limiting examples of therapeutic agents for Sciatica with which binding proteins can be combined are provided and include the following: hydrocodone bitartrate/apap, rofecoxib, cyclobenzaprine hcl, methylprednisolone, naproxen, ibuprofen, oxycodone hcl/acetaminophen, celecoxib, valdecoxib, methylprednisolone acetate, prednisone, codeine phosphate/apap, tramadol hcl/acetaminophen, metaxalone, meloxicam, methocarbamol, lidocaine hydrochloride, diclofenac sodium, gabapentin, dexamethasone, carisoprodol, ketorolac tromethamine, indomethacin, acetaminophen, diazepam, nabumetone, oxycodone hcl, tizanidine hcl, diclofenac sodium/misoprostol, propoxyphene napsylate/ apap, asa/oxycod/oxycodone ter, ibuprofen/hydrocodone bit, tramadol hcl, etodolac, propoxyphene hcl, amitriptyline hcl, carisoprodol/codeine phos/asa, morphine sulfate, multivitamins, naproxen sodium, orphenadrine citrate, temazepam.

Examples of therapeutic agents for SLE (Lupus) in which binding proteins can be combined are provided and include the following: NSAIDS, for example, diclofenac, naproxen, ibuprofen, piroxicam, indomethacin; COX2 inhibitors, for example, Celecoxib, rofecoxib, valdecoxib; anti-malarials, for example, hydroxychloroquine; Steroids, for example, prednisone, prednisolone, budenoside, dexamethasone; Cytotoxics, for example, azathioprine, cyclophosphamide, mycophenolate mofetil, methotrexate; inhibitors of PDE4 or purine synthesis inhibitor, for example Cellcept. Binding proteins may also be combined with agents such as sulfasalazine, 5-aminosalicylic acid, olsalazine, Imuran and agents which interfere with synthesis, production or action of proinflammatory cytokines such as IL-1, for example, caspase inhibitors like IL-1β converting enzyme inhibitors and IL-1ra. Binding proteins may also be used with T cell signaling inhibitors, for example, tyrosine kinase inhibitors; or molecules that target T cell activation molecules, for example, CTLA-4-IgG or anti-B7 family antibodies, anti-PD-1 family antibodies. Binding proteins can be combined with IL-11 or anti-cytokine antibodies, for example, fonotolizumab (anti-IFNg antibody), or anti-receptor receptor antibodies, for example, anti-IL-6 receptor antibody and antibodies to B-cell surface molecules. Antibodies or antigen binding portion thereof may also be used with LJP 394 (abetimus), agents that deplete or inactivate B-cells, for example, Rituximab (anti-CD20antibody), lymphostat-B (anti-B1yS antibody), TNF antagonists, for example, anti-TNF antibodies, Adalimumab (PCT Publication No. WO 97/29131; HUMIRA®), CA2 (REMICADE®), CDP 571, TNFR-Ig constructs, (p75TNFRIgG (ENBREL®) and p55TNFRIgG (LENERCEPT®)) and bcl-2 inhibitors, because bcl-2 overexpression in transgenic mice has been demonstrated to cause a lupus like phenotype (see Marquina, Regina et al., Journal of Immunology (2004), 172(11), 7177-7185), therefore inhibition is expected to have therapeutic effects.

The pharmaceutical compositions may include a "therapeutically effective amount" or a "prophylactically effective amount" of an antibody or antibody portion thereof. A "therapeutically effective amount" refers to an amount effective, at dosages and for periods of time necessary, to achieve the desired therapeutic result. A therapeutically effective amount of the antibody or antibody portion may be determined by a person skilled in the art and may vary according to factors such as the disease state, age, sex, and weight of the individual, and the ability of the antibody or antibody portion to elicit a desired response in the individual. A therapeutically effective amount is also one in which any toxic or detrimental effects of the antibody, or antibody portion, are outweighed by the therapeutically beneficial effects. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

Dosage regimens may be adjusted to provide the optimum desired response (e.g., a therapeutic or prophylactic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. The term "dosage unit form" refers to physically discrete units suited as unitary dosages for the mammalian subjects to be treated; each unit containing a predetermined quantity of active compound calculated to produce the desired therapeutic effect in association with the required pharmaceutical carrier. The specification for the dosage unit forms are dictated by and directly dependent on (a) the unique characteristics of the active compound and the particular therapeutic or prophylactic effect to be achieved, and (b) the limitations inherent in the art of compounding such an active compound for the treatment of sensitivity in individuals.

It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed composition.

VIII. Diagnostics

The disclosure herein also provides diagnostic applications. This is further elucidated below. Antibodies that bind sclerostin are provided and may be employed in any of a variety of formats to detect sclerostin in vivo, in vitro, or ex vivo (i.e., in cells or tissues that have been obtained from a living individual, subjected to a procedure, then returned to the individual). DVD-binding proteins offer the further advantage of being capable of binding to an epitope of sclerostin as well as other antigens or epitopes in various diagnostic and detection assay formats.

I. Method of Assay

The present disclosure also provides a method for determining the presence, amount or concentration of a sclerostin, or a fragment thereof, ("analyte") in a test sample using at least one anti-sclerostin binding protein or antigen binding portion thereof, including a DVD-binding protein, as described herein. Any suitable assay as is known in the art can be used in the method. Examples include, but are not limited to, immunoassay, such as sandwich immunoassay (e.g., monoclonal, polyclonal and/or DVD-binding protein sandwich immunoassays or any variation thereof (e.g., monoclonal/DVD-binding protein, DVD-binding protein/polyclonal, etc.), including radioisotope detection (radioimmunoassay (RIA)) and enzyme detection (enzyme immunoassay (EIA) or enzyme-linked immunosorbent assay (ELISA) (e.g., Quantikine ELISA assays, R&D Systems, Minneapolis, Minn.))), competitive inhibition immunoassay (e.g., forward and reverse), fluorescence polarization immunoassay (FPIA), enzyme multiplied immunoassay technique (EMIT), bioluminescence resonance energy transfer (BRET), and homogeneous chemiluminescent assay, etc. In a SELDI-based immunoassay, a capture reagent that specifically binds an analyte (or a fragment thereof) of interest is attached to the surface of a mass spectrometry probe, such as a pre-activated protein chip array. The analyte (or a fragment thereof) is then specifically captured on the biochip, and the captured analyte (or a fragment thereof) is detected by mass spectrometry. Alternatively, the analyte (or a fragment thereof) can be eluted from the capture reagent and detected by traditional MALDI (matrix-assisted laser desorption/ionization) or by SELDI. A chemiluminescent microparticle immunoassay, in particular one employing the ARCHITECT® automated analyzer (Abbott Laboratories, Abbott Park, Ill.), is an example of an immunoassay.

Methods well-known in the art for collecting, handling and processing urine, blood, serum and plasma, and other body fluids, are used in the practice of the present disclosure, for instance, when anti-sclerostin binding protein as described herein is employed as an immunodiagnostic reagent and/or in an analyte immunoassay kit. The test sample can comprise further moieties in addition to the analyte of interest, such as antibodies, antigens, haptens, hormones, drugs, enzymes, receptors, proteins, peptides, polypeptides, oligonucleotides and/or polynucleotides. For example, the sample can be a whole blood sample obtained from a subject. It can be necessary or desired that a test sample, particularly whole blood, be treated prior to immunoassay as described herein, e.g., with a pretreatment reagent. Even in cases where pretreatment is not necessary (e.g., most urine samples), pretreatment optionally can be done (e.g., as part of a regimen on a commercial platform).

The pretreatment reagent can be any reagent appropriate for use with the immunoassay and kits. The pretreatment optionally comprises: (a) one or more solvents (e.g., methanol and ethylene glycol) and optionally, salt, (b) one or more solvents and salt, and optionally, detergent, (c) detergent, or (d) detergent and salt. Pretreatment reagents are known in the art, and such pretreatment can be employed, e.g., as used for assays on Abbott TDx, AxSYM®, and ARCHITECT® analyzers (Abbott Laboratories, Abbott Park, Ill.), as described in the literature (see, e.g., Yatscoff et al., Abbott TDx Monoclonal Antibody Assay Evaluated for Measuring Cyclosporine in Whole Blood, Clin. Chem. 36: 1969-1973 (1990), and Wallemacq et al., Evaluation of the New AxSYM Cyclosporine Assay: Comparison with TDx Monoclonal Whole Blood and EMIT Cyclosporine Assays, Clin. Chem. 45: 432-435 (1999)), and/or as commercially available. Additionally, pretreatment can be done as described in Abbott's U.S. Pat. No. 5,135,875; European Patent Publication No. 0 471 293; PCT Publication No. WO 2008/082984; and US Patent Application Publication No. 2008/0020401. The pretreatment reagent can be a heterogeneous agent or a homogeneous agent.

With use of a heterogeneous pretreatment reagent, the pretreatment reagent precipitates analyte binding protein (e.g., protein that can bind to an analyte or a fragment thereof) present in the sample. Such a pretreatment step comprises removing any analyte binding protein by separating from the precipitated analyte binding protein the supernatant of the mixture formed by addition of the pretreatment agent to sample. In such an assay, the supernatant of the mixture absent any binding protein is used in the assay, proceeding directly to the antibody capture step.

With use of a homogeneous pretreatment reagent there is no such separation step. The entire mixture of test sample and pretreatment reagent are contacted with a labeled specific binding partner for analyte (or a fragment thereof), such as a labeled anti-analyte antibody (or an antigenically reactive fragment thereof). The pretreatment reagent employed for such an assay typically is diluted in the pretreated test sample mixture, either before or during capture by the first specific binding partner. Despite such dilution, a certain amount of the pretreatment reagent is still present (or remains) in the test sample mixture during capture. An exemplary labeled specific binding partner can be a DVD-binding protein (or a fragment, a variant, or a fragment of a variant thereof).

In a heterogeneous format, after the test sample is obtained from a subject, a first mixture is prepared. The mixture contains the test sample being assessed for an analyte (or a fragment thereof) and a first specific binding partner, wherein the first specific binding partner and any analyte contained in the test sample form a first specific binding partner-analyte complex. In an embodiment, the first specific binding partner is an anti-analyte antibody or a fragment thereof. The first specific binding partner can be a DVD-binding protein (or a fragment, a variant, or a fragment of a variant thereof) as described herein. The order in which the test sample and the first specific binding partner are added to form the mixture is not critical. In an embodiment, the first specific binding partner is immobilized on a solid phase. The solid phase used in the immunoassay (for the first specific binding partner and, optionally, the second specific binding partner) can be any solid phase known in the art, such as, but not limited to, a magnetic particle, a bead, a test tube, a microtiter plate, a cuvette, a membrane, a scaffolding molecule, a film, a filter paper, a disc and a chip.

After the mixture containing the first specific binding partner-analyte complex is formed, any unbound analyte is removed from the complex using any technique known in the art. For example, the unbound analyte can be removed by washing. Desirably, however, the first specific binding partner is present in excess of any analyte present in the test sample, such that all analyte that is present in the test sample is bound by the first specific binding partner.

After any unbound analyte is removed, a second specific binding partner is added to the mixture to form a first specific binding partner-analyte-second specific binding partner complex. The second specific binding partner is, e.g., an anti-analyte antibody that binds to an epitope on analyte that differs from the epitope on analyte bound by the first specific binding partner. Moreover, in an embodiment, the second specific binding partner is labeled with or contains a detectable label as described above. The second specific binding partner can be a DVD-binding protein (or a fragment, a variant, or a fragment of a variant thereof) as described herein.

Any suitable detectable label as is known in the art can be used. For example, the detectable label can be a radioactive label (such as $^3$H, $^{125}$I, $^{35}$S, $^{14}$C, $^{32}$P, and $^{33}$P), an enzymatic label (such as horseradish peroxidase, alkaline peroxidase, glucose 6-phosphate dehydrogenase, and the like), a chemiluminescent label (such as acridinium esters, thioesters, or sulfonamides; luminol, isoluminol, phenanthridinium esters, and the like), a fluorescent label (such as fluorescein (e.g., 5-fluorescein, 6-carboxyfluorescein, 3'6-carboxyfluorescein, 5(6)-carboxyfluorescein, 6-hexachloro-fluorescein, 6-tetra-chlorofluorescein, fluorescein isothiocyanate, and the like)), rhodamine, phycobiliproteins, R-phycoerythrin, quantum dots (e.g., zinc sulfide-capped cadmium selenide), a thermometric label, or an immuno-polymerase chain reaction label. An introduction to labels, labeling procedures and detection of labels is found in Polak and Van Noorden, Introduction to Immunocytochemistry, 2nd ed.; Springer Verlag, N.Y. (1997), and in Haugland, Handbook of Fluorescent Probes and Research Chemicals (1996), which is a combined handbook and catalogue published by Molecular Probes, Inc., Eugene, Oreg. A fluorescent label can be used in FPIA (see, e.g., U.S. Pat. Nos. 5,593,896, 5,573,904, 5,496,925, 5,359, 093, and 5,352,803). An acridinium compound can be used as a detectable label in a homogeneous or heterogeneous chemiluminescent assay (see, e.g., Adamczyk et al., Bioorg. Med. Chem. Lett. 16: 1324-1328 (2006); Adamczyk et al., Bioorg. Med. Chem. Lett. 4: 2313-2317 (2004); Adamczyk et al., Biorg. Med. Chem. Lett. 14: 3917-3921 (2004); and Adamczyk et al., Org. Lett. 5: 3779-3782 (2003)).

An exemplary acridinium compound is an acridinium-9-carboxamide. Methods for preparing acridinium 9-carboxamides are described in Mattingly, J. Biolumin. Chemilumin. 6: 107-114 (1991); Adamczyk et al., J. Org. Chem., 63: 5636-5639 (1998); Adamczyk et al., Tetrahedron, 55: 10899-10914 (1999); Adamczyk et al., Org. Lett., 1: 779-781 (1999); Adamczyk et al., Bioconjugate Chem., 11: 714-724 (2000); Mattingly et al., In Luminescence Biotechnology: Instruments and Applications; Dyke, K. V. Ed.; CRC Press: Boca Raton, pp. 77-105 (2002); Adamczyk et al., Org. Lett., 5: 3779-3782 (2003); and U.S. Pat. Nos. 5,468,646, 5,543,524 and 5,783,699. Another exemplary acridinium compound is an acridinium-9-carboxylate aryl ester. An example of an acridinium-9-carboxylate aryl ester is 10-methyl-9-(phenoxycarbonyliacridinium fluorosulfonate (available from Cayman Chemical, Ann Arbor, Mich.). Methods for preparing acridinium 9-carboxylate aryl esters are described in McCapra et al., Photochem. Photobiol., 4: 1111-21 (1965); Razavi et al., Luminescence, 15: 245-249 (2000); Razavi et al., Luminescence, 15: 239-244 (2000); and U.S. Pat. No. 5,241,070. Further details regarding acridinium-9-carboxylate aryl ester and its use are set forth in US 2008-0248493.

Chemiluminescent assays (e.g., using acridinium as described above or other chemiluminescent agents) can be performed in accordance with the methods described in Adamczyk et al., Anal. Chim. Acta, 579(1): 61-67 (2006). While any suitable assay format can be used, a microplate chemiluminometer (Mithras LB-940, Berthold Technologies U.S.A., LLC, Oak Ridge, Tenn.) enables the assay of multiple samples of small volumes rapidly.

The order in which the test sample and the specific binding partner(s) are added to form the mixture for chemiluminescent assay is not critical. If the first specific binding partner is detectably labeled with a chemiluminescent agent such as an acridinium compound, detectably labeled first specific binding partner-analyte complexes form. Alternatively, if a second specific binding partner is used and the second specific binding partner is detectably labeled with a chemiluminescent agent such as an acridinium compound, detectably labeled first specific binding partner-analyte-second specific binding partner complexes form. Any unbound specific binding partner, whether labeled or unlabeled, can be removed from the mixture using any technique known in the art, such as washing.

Hydrogen peroxide can be generated in situ in the mixture or provided or supplied to the mixture (e.g., the source of the hydrogen peroxide being one or more buffers or other solutions that are known to contain hydrogen peroxide) before, simultaneously with, or after the addition of an above-described acridinium compound. Hydrogen peroxide can be generated in situ in a number of ways such as would be apparent to one skilled in the art.

Upon the simultaneous or subsequent addition of at least one basic solution to the sample, a detectable signal, namely, a chemiluminescent signal, indicative of the presence of analyte is generated. The basic solution contains at least one base and has a pH greater than or equal to 10, e.g., greater than or equal to 12. Examples of basic solutions include, but are not limited to, sodium hydroxide, potassium hydroxide, calcium hydroxide, ammonium hydroxide, magnesium hydroxide, sodium carbonate, sodium bicarbonate, calcium hydroxide, calcium carbonate, and calcium bicarbonate. The amount of basic solution added to the sample depends on the concentration of the basic solution. Based on the concentration of the basic solution used, one skilled in the art can easily determine the amount of basic solution to add to the sample.

The chemiluminescent signal that is generated can be detected using routine techniques known to those skilled in the art. Based on the intensity of the signal generated, the amount of analyte in the sample can be quantified. Specifically, the amount of analyte in the sample is proportional to the intensity of the signal generated. The amount of analyte present can be quantified by comparing the amount of light generated to a standard curve for analyte or by comparison to a reference standard. The standard curve can be generated using serial dilutions or solutions of known concentrations of analyte by mass spectroscopy, gravimetric methods, and other techniques known in the art. While the above is described with emphasis on use of an acridinium compound as the chemiluminescent agent, one of ordinary skill in the art can readily adapt this description for use of other chemiluminescent agents.

Analyte immunoassays generally can be conducted using any format known in the art, such as, but not limited to, a sandwich format. Specifically, in one immunoassay format, at least two antibodies are employed to separate and quantify analyte, such as human analyte, or a fragment thereof in a sample. More specifically, the at least two antibodies bind to different epitopes on an analyte (or a fragment thereof) forming an immune complex, which is referred to as a "sandwich." Generally, in the immunoassays one or more antibodies can be used to capture the analyte (or a fragment thereof) in the test sample (these antibodies are frequently referred to as a "capture" antibody or "capture" antibodies) and one or more antibodies can be used to bind a detectable (namely, quantifiable) label to the sandwich (these antibodies are frequently referred to as the "detection antibody," the "detection antibodies," the "conjugate," or the "conjugates"). Thus, in the context of a sandwich immunoassay format, a DVD-binding protein (or a fragment, a variant, or a fragment of a variant thereof) as described herein can be used as a capture antibody, a detection antibody, or both. For example, one DVD-binding protein having a domain that can bind a first epitope on an analyte (or a fragment thereof) can be used as a capture antibody and/or another DVD-binding protein having a domain that can bind a second epitope on an analyte (or a fragment thereof) can be used as a detection antibody. In this regard, a DVD-binding protein having a first domain that can bind a first epitope on an analyte (or a fragment thereof) and a second domain that can bind a second epitope on an analyte (or a fragment thereof) can be used as a capture antibody and/or a detection antibody. Alternatively, one DVD-binding protein having a first domain that can bind an epitope on a first analyte (or a fragment thereof) and a second domain that can bind an epitope on a second analyte (or a fragment thereof) can be used as a capture antibody and/or a detection antibody to detect, and optionally quantify, two or more analytes. In the event that an analyte can be present in a sample in more than one form, such as a monomeric form and a dimeric/multimeric form, which can be homomeric or heteromeric, one DVD-binding protein having a domain that can bind an epitope that is only exposed on the monomeric form and another DVD-binding protein having a domain that can bind an epitope on a different part of a dimeric/multimeric form can be used as capture antibodies and/or detection antibodies, thereby enabling the detection, and optional quantification, of different forms of a given analyte. Furthermore, employing DVD-binding proteins with differential affinities within a single DVD-binding protein and/or between DVD-binding proteins can provide an avidity advantage. In the context of immunoassays as described herein, it generally may be helpful or desired to incorporate one or more linkers within the structure of a DVD-binding protein. When present, optimally the linker should be of sufficient length and structural flexibility to enable binding of an epitope by the inner domains as well as binding of another epitope by the outer domains. In this regard, if a DVD-binding protein can bind two different analytes and one analyte is larger than the other, desirably the larger analyte is bound by the outer domains.

Generally speaking, a sample being tested for (for example, suspected of containing) an SOST protein (or a fragment thereof) can be contacted with at least one capture antibody (or antibodies) and at least one detection antibody (which can be a second detection antibody or a third detection antibody or even a successively numbered antibody, e.g., as where the capture and/or detection antibody comprise multiple antibodies) either simultaneously or sequentially and in any order. For example, the test sample can be first contacted with at least one capture antibody and then (sequentially) with at least one detection antibody. Alternatively, the test sample can be first contacted with at least one detection antibody and then (sequentially) with at least one capture antibody. In yet another alternative, the test sample can be contacted simultaneously with a capture antibody and a detection antibody.

In the sandwich assay format, a sample suspected of containing SOST (or a fragment thereof) is first brought into contact with at least one first capture binding protein (e.g., SOST antibody) under conditions that allow the formation of a first binding protein/SOST complex. If more than one capture binding protein is used, a first capture binding protein/SOST complex comprising two or more capture binding proteins forms. In a sandwich assay, the binding proteins, i.e., e.g., the at least one capture binding protein, are used in molar excess amounts of the maximum amount of SOST analyte (or a fragment thereof) expected in the test sample. For example, from about 5 μg to about 1 mg of antibody per mL of buffer (e.g., microparticle coating buffer) can be used.

Competitive inhibition immunoassays, which are often used to measure small analytes because binding by only one antibody is required, comprise sequential and classic formats. In a sequential competitive inhibition immunoassay a capture binding protein to sclerostin is coated onto a well of a microtiter plate or other solid support. When the sample containing the sclerostin is added to the well, the sclerostin binds to the capture binding protein. After washing, a known amount of labeled (e.g., biotin or horseradish peroxidase (HRP)) sclerostin is added to the well. A substrate for an enzymatic label is necessary to generate a signal. An example of a suitable substrate for HRP is 3,3',5,5'-tetramethylbenzidine (TMB). After washing, the signal generated by the labeled analyte is measured and is inversely proportional to the amount of sclerostin in the sample. In a classic competitive inhibition immunoassay, a binding protein to sclerostin is coated onto a solid support (e.g., a well of a microtiter plate). However, unlike the sequential competitive inhibition immunoassay, the sample and the labeled sclerostin are added to the well at the same time. Any sclerostin in the sample competes with labeled sclerostin for binding to the capture binding protein. After washing, the signal generated by the labeled sclerostin is measured and is inversely proportional to the amount of sclerostin in the sample.

Optionally, prior to contacting the test sample with the at least one capture binding protein (for example, the first capture antibody), the at least one capture binding protein can be bound to a solid support, which facilitates the separation of the first binding protein/sclerostin (or a fragment thereof) complex from the test sample. The substrate to which the capture binding protein is bound can be any suitable solid support or solid phase that facilitates separation of the capture antibody-analyte complex from the sample.

Examples include a well of a plate, such as a microtiter plate, a test tube, a porous gel (e.g., silica gel, agarose, dextran, or gelatin), a polymeric film (e.g., polyacrylamide), beads (e.g., polystyrene beads or magnetic beads), a strip of a filter/membrane (e.g., nitrocellulose or nylon), microparticles (e.g., latex particles, magnetizable microparticles (e.g., microparticles having ferric oxide or chromium oxide cores and homo- or hetero-polymeric coats and radii of about 1-10 microns). The substrate can comprise a suitable porous material with a suitable surface affinity to bind antigens and sufficient porosity to allow access by detection antibodies. A microporous material is generally preferred, although a gelatinous material in a hydrated state can be used. Such porous substrates are, e.g., in the form of sheets having a thickness of about 0.01 to about 0.5 mm, e.g., about 0.1 mm. While the pore size may vary quite a bit, e.g., the pore size is from about 0.025 to about 15 microns, e.g., from about 0.15 to about 15 microns. The surface of such substrates can be activated by chemical processes that cause covalent linkage of an antibody to the substrate. Irreversible binding, generally by adsorption through hydrophobic forces, of the antigen or the antibody to the substrate results; alternatively, a chemical coupling agent or other means can be used to bind covalently the antibody to the substrate, provided that such binding does not interfere with the ability of the antibody to bind to analyte. Alternatively, the antibody can be bound with microparticles, which have been previously coated with streptavidin (e.g., DYNAL® Magnetic Beads, Invitrogen, Carlsbad, Calif.) or biotin (e.g., using Power-Bind™-SA-MP streptavidin-coated microparticles (Seradyn, Indianapolis, Ind.)) or anti-species-specific monoclonal antibodies. If necessary, the substrate can be derivatized to allow reactivity with various functional groups on the antibody. Such derivatization requires the use of certain coupling agents, examples of which include, but are not limited to, maleic anhydride, N-hydroxysuccinimide, and 1-ethyl-3-(3-dimethylaminopropyl) carbodiimide If desired, one or more capture reagents, such as antibodies (or fragments thereof), each of which is specific for analyte(s) can be attached to solid phases in different physical or addressable locations (e.g., such as in a biochip configuration (see, e.g., U.S. Pat. No. 6,225,047; PCT Publication No. WO 99/51773; U.S. Pat. No. 6,329,209; PCT Publication No. WO 00/56934; and U.S. Pat. No. 5,242,828). If the capture reagent is attached to a mass spectrometry probe as the solid support, the amount of analyte bound to the probe can be detected by laser desorption ionization mass spectrometry. Alternatively, a single column can be packed with different beads, which are derivatized with the one or more capture reagents, thereby capturing the analyte in a single place (see, antibody-derivatized, bead-based technologies, e.g., the xMAP technology of Luminex (Austin, Tex.)).

After the test sample being assayed for analyte (or a fragment thereof) is brought into contact with the at least one capture antibody (for example, the first capture antibody), the mixture is incubated in order to allow for the formation of a first antibody (or multiple antibody)-analyte (or a fragment thereof) complex. The incubation can be carried out at a pH of from about 4.5 to about 10.0, at a temperature of from about 2° C. to about 45° C., and for a period from at least about one (1) minute to about eighteen (18) hours, e.g., from about 1 to about 24 minutes, e.g., for about 4 to about 18 minutes. The immunoassay described herein can be conducted in one step (meaning the test sample, at least one capture antibody and at least one detection antibody are all added sequentially or simultaneously to a reaction vessel) or in more than one step, such as two steps, three steps, etc.

After formation of the (first or multiple) capture antibody/analyte (or a fragment thereof) complex, the complex is then contacted with at least one detection antibody under conditions which allow for the formation of a (first or multiple) capture antibody/analyte (or a fragment thereof)/second detection antibody complex). While captioned for clarity as the "second" antibody (e.g., second detection antibody), in fact, where multiple antibodies are used for capture and/or detection, the at least one detection antibody can be the second, third, fourth, etc. antibodies used in the immunoassay. If the capture antibody/analyte (or a fragment thereof) complex is contacted with more than one detection antibody, then a (first or multiple) capture antibody/analyte (or a fragment thereof)/(multiple) detection antibody complex is formed. As with the capture antibody (e.g., the first capture antibody), when the at least one (e.g., second and any subsequent) detection antibody is brought into contact with the capture antibody/analyte (or a fragment thereof) complex, a period of incubation under conditions similar to those described above is required for the formation of the (first or multiple) capture antibody/analyte (or a fragment thereof)/(second or multiple) detection antibody complex. In an embodiment, at least one detection antibody contains a detectable label. The detectable label can be bound to the at least one detection antibody (e.g., the second detection antibody) prior to, simultaneously with, or after the formation of the (first or multiple) capture antibody/analyte (or a fragment thereof)/(second or multiple) detection antibody complex. Any detectable label known in the art can be used (see discussion above, including of the Polak and Van Noorden (1997) and Haugland (1996) references).

The detectable label can be bound to the antibodies either directly or through a coupling agent. An example of a coupling agent that can be used is EDAC (1-ethyl-3-(3-dimethylaminopropyl) carbodiimide, hydrochloride), which is commercially available from Sigma-Aldrich, St. Louis, Mo. Other coupling agents that can be used are known in the art. Methods for binding a detectable label to an antibody are known in the art. Additionally, many detectable labels can be purchased or synthesized that already contain end groups that facilitate the coupling of the detectable label to the antibody, such as CPSP-Acridinium Ester (i.e., 9-[N-tosyl-N-(3-carboxypropyl)]-10-(3-sulfopropyl)acridinium carboxamide) or SPSP-Acridinium Ester (i.e., N10-(3-sulfopropyl)-N-(3-sulfopropyl)-acridinium-9-carboxamide).

The (first or multiple) capture antibody/analyte/(second or multiple) detection antibody complex can be, but does not have to be, separated from the remainder of the test sample prior to quantification of the label. For example, if the at least one capture antibody (e.g., the first capture antibody) is bound to a solid support, such as a well or a bead, separation can be accomplished by removing the fluid (of the test sample) from contact with the solid support. Alternatively, if the at least first capture antibody is bound to a solid support, it can be simultaneously contacted with the analyte-containing sample and the at least one second detection antibody to form a first (multiple) antibody/analyte/second (multiple) antibody complex, followed by removal of the fluid (test sample) from contact with the solid support. If the at least one first capture antibody is not bound to a solid support, then the (first or multiple) capture antibody/analyte/(second or multiple) detection antibody complex does not have to be removed from the test sample for quantification of the amount of the label.

After formation of the labeled capture antibody/analyte/detection antibody complex (e.g., the first capture antibody/analyte/second detection antibody complex), the amount of label in the complex is quantified using techniques known in the art. For example, if an enzymatic label is used, the labeled complex is reacted with a substrate for the label that gives a quantifiable reaction such as the development of color. If the label is a radioactive label, the label is quantified using appropriate means, such as a scintillation counter. If the label is a fluorescent label, the label is quantified by stimulating the label with a light of one color (which is known as the "excitation wavelength") and detecting another color (which is known as the "emission wavelength") that is emitted by the label in response to the stimulation. If the label is a chemiluminescent label, the label is quantified by detecting the light emitted either visually or by using luminometers, x-ray film, high speed photographic film, a CCD camera, etc. Once the amount of the label in the complex has been quantified, the concentration of analyte or a fragment thereof in the test sample is determined by appropriate means, such as by use of a standard curve that has been generated using serial dilutions of analyte or a fragment thereof of known concentration. Other than using serial dilutions of analyte or a fragment thereof, the standard curve can be generated gravimetrically, by mass spectroscopy and by other techniques known in the art.

In a chemiluminescent microparticle assay employing the ARCHITECT® analyzer, the conjugate diluent pH should be about 6.0+/−0.2, the microparticle coating buffer should be maintained at about room temperature (i.e., at from about 17 to about 27° C.), the microparticle coating buffer pH should be about 6.5+/−0.2, and the microparticle diluent pH should be about 7.8+/−0.2. In an embodiment, solids are less than about 0.2%, such as less than about 0.15%, less than about 0.14%, less than about 0.13%, less than about 0.12%, or less than about 0.11%, such as about 0.10%.

FPIAs are based on competitive binding immunoassay principles. A fluorescently labeled compound, when excited by a linearly polarized light, will emit fluorescence having a degree of polarization inversely proportional to its rate of rotation. When a fluorescently labeled tracer-antibody complex is excited by a linearly polarized light, the emitted light remains highly polarized because the fluorophore is constrained from rotating between the time light is absorbed and the time light is emitted. When a "free" tracer compound (i.e., a compound that is not bound to an antibody) is excited by linearly polarized light, its rotation is much faster than the corresponding tracer-antibody conjugate produced in a competitive binding immunoassay. FPIAs are advantageous over RIAs inasmuch as there are no radioactive substances requiring special handling and disposal. In addition, FPIAs are homogeneous assays that can be easily and rapidly performed.

In view of the above, a method of determining the presence, amount, or concentration of analyte (or a fragment thereof) in a test sample is provided. The method comprises assaying the test sample for an analyte (or a fragment thereof) by an assay (i) employing (i') at least one of an antibody, a fragment of an antibody that can bind to an analyte, a variant of an antibody that can bind to an analyte, a fragment of a variant of an antibody that can bind to an analyte, and a DVD-binding protein (or a fragment, a variant, or a fragment of a variant thereof) that can bind to an analyte, and (ii') at least one detectable label and (ii) comprising comparing a signal generated by the detectable label as a direct or indirect indication of the presence, amount or concentration of analyte (or a fragment thereof) in the test sample to a signal generated as a direct or indirect indication of the presence, amount or concentration of analyte (or a fragment thereof) in a control or calibrator. The calibrator is optionally part of a series of calibrators, in which each of the calibrators differs from the other calibrators by the concentration of analyte.

The method can comprise (i) contacting the test sample with at least one first specific binding partner for analyte (or a fragment thereof) of an antibody, a fragment of an antibody that can bind to an analyte, a variant of an antibody that can bind to an analyte, a fragment of a variant of an antibody that can bind to an analyte, or a DVD-binding protein (or a fragment, a variant, or a fragment of a variant thereof) that can bind to an analyte so as to form a first specific binding partner/analyte (or fragment thereof) complex, (ii) contacting the first specific binding partner/analyte (or fragment thereof) complex with at least one second specific binding partner for analyte (or fragment thereof) of a detectably labeled anti-analyte antibody, a detectably labeled fragment of an anti-analyte antibody that can bind to analyte, a detectably labeled variant of an anti-analyte antibody that can bind to analyte, a detectably labeled fragment of a variant of an anti-analyte antibody that can bind to analyte, or a detectably labeled DVD-binding protein (or a fragment, a variant, or a fragment of a variant thereof) so as to form a first specific binding partner/analyte (or fragment thereof)/second specific binding partner complex, and (iii) determining the presence, amount or concentration of analyte in the test sample by detecting or measuring the signal generated by the detectable label in the first specific binding partner/analyte (or fragment thereof)/second specific binding partner complex formed in (ii). A method in which at least one first specific binding partner for analyte (or a fragment thereof) and/or at least one second specific binding partner for analyte (or a fragment thereof) is a DVD-binding protein (or a fragment, a variant, or a fragment of a variant thereof) as described herein can be preferred.

Alternatively, the method can comprise contacting the test sample with at least one first specific binding partner for an SOST analyte (or a fragment thereof) of an antibody, a fragment of an antibody that can bind to an analyte, a variant of an antibody that can bind to an analyte, a fragment of a variant of an antibody that can bind to an analyte, or a DVD-binding protein (or a fragment, a variant, or a fragment of a variant thereof) and simultaneously or sequentially, in either order, contacting the test sample with at least one second specific binding partner, which can compete with analyte (or a fragment thereof) for binding to the at least one first specific binding partner and which is a detectably labeled analyte, a detectably labeled fragment of analyte that can bind to the first specific binding partner, a detectably labeled variant of analyte that can bind to the first specific binding partner, or a detectably labeled fragment of a variant of analyte that can bind to the first specific binding partner. Any SOST (or a fragment thereof) present in the test sample and the at least one second specific binding partner compete with each other to form a first specific binding partner/analyte (or fragment thereof) complex and a first specific binding partner/second specific binding partner complex, respectively. The method further comprises determining the presence, amount or concentration of analyte in the test sample by detecting or measuring the signal generated by the detectable label in the first specific binding partner/second specific binding partner complex formed in (ii), wherein the signal generated by the detectable label in the first specific binding partner/second specific binding partner complex is inversely proportional to the amount or concentration of analyte in the test sample.

The above methods can further comprise diagnosing, prognosticating, or assessing the efficacy of a therapeutic/prophylactic treatment of a patient from whom the test sample was obtained. If the method further comprises assessing the efficacy of a therapeutic/prophylactic treatment of the patient from whom the test sample was obtained, the method optionally further comprises modifying the therapeutic/prophylactic treatment of the patient as needed to improve efficacy. The method can be adapted for use in an automated system or a semi-automated system.

With regard to the methods of assay (and kit therefor), it may be possible to employ commercially available anti-analyte antibodies or methods for production of anti-analyte as described in the literature. Commercial supplies of various antibodies include, but are not limited to, Santa Cruz Biotechnology Inc. (Santa Cruz, Calif.), GenWay Biotech, Inc. (San Diego, Calif.), and R&D Systems (RDS; Minneapolis, Minn.).

Generally, a predetermined level can be employed as a benchmark against which to assess results obtained upon assaying a test sample for analyte or a fragment thereof, e.g., for detecting disease or risk of disease. Generally, in making such a comparison, the predetermined level is obtained by running a particular assay a sufficient number of times and under appropriate conditions such that a linkage or association of analyte presence, amount or concentration with a particular stage or endpoint of a disease, disorder or condition or with particular clinical indicia can be made. Typically, the predetermined level is obtained with assays of reference subjects (or populations of subjects). The analyte measured can include fragments thereof, degradation products thereof, and/or enzymatic cleavage products thereof.

In particular, with respect to a predetermined level as employed for monitoring disease progression and/or treatment, the amount or concentration of analyte or a fragment thereof may be "unchanged," "favorable" (or "favorably altered"), or "unfavorable" (or "unfavorably altered"). "Elevated" or "increased" refers to an amount or a concentration in a test sample that is higher than a typical or normal level or range (e.g., predetermined level), or is higher than another reference level or range (e.g., earlier or baseline sample). The term "lowered" or "reduced" refers to an amount or a concentration in a test sample that is lower than a typical or normal level or range (e.g., predetermined level), or is lower than another reference level or range (e.g., earlier or baseline sample). The term "altered" refers to an amount or a concentration in a sample that is altered (increased or decreased) over a typical or normal level or range (e.g., predetermined level), or over another reference level or range (e.g., earlier or baseline sample).

The typical or normal level or range for analyte is defined in accordance with standard practice. Because the levels of analyte in some instances will be very low, a so-called altered level or alteration can be considered to have occurred when there is any net change as compared to the typical or normal level or range, or reference level or range, that cannot be explained by experimental error or sample variation. Thus, the level measured in a particular sample will be compared with the level or range of levels determined in similar samples from a so-called normal subject. In this context, a "normal subject" is an individual with no detectable disease, for example, and a "normal" (sometimes termed "control") patient or population is/are one(s) that exhibit(s) no detectable disease, respectively, for example. Furthermore, given that analyte is not routinely found at a high level in the majority of the human population, a "normal subject" can be considered an individual with no substantial detectable increased or elevated amount or concentration of analyte, and a "normal" (sometimes termed "control") patient or population is/are one(s) that exhibit(s) no substantial detectable increased or elevated amount or concentration of analyte. An "apparently normal subject" is one in which analyte has not yet been or currently is being assessed. The level of an analyte is said to be "elevated" when the analyte is normally undetectable (e.g., the normal level is zero, or within a range of from about 25 to about 75 percentiles of normal populations), but is detected in a test sample, as well as when the analyte is present in the test sample at a higher than normal level. Thus, inter alia, the disclosure provides a method of screening for a subject having, or at risk of having, a particular disease, disorder, or condition. The method of assay can also involve the assay of other markers and the like.

Accordingly, the methods described herein also can be used to determine whether or not a subject has or is at risk of developing a given disease, disorder or condition. Specifically, such a method can comprise the steps of:

(a) determining the concentration or amount in a test sample from a subject of sclerostin (or a fragment thereof) (e.g., using the methods described herein, or methods known in the art); and (b) comparing the concentration or amount of sclerostin (or a fragment thereof) determined in step (a) with a predetermined level, wherein, if the concentration or amount of analyte determined in step (a) is favorable with respect to a predetermined level, then the subject is determined not to have or be at risk for a given disease, disorder or condition. However, if the concentration or amount of sclerostin determined in step (a) is unfavorable with respect to the predetermined level, then the subject is determined to have or be at risk for a given disease, disorder or condition.

Additionally, provided herein is method of monitoring the progression of disease in a subject. Optimally the method comprising the steps of:

(a) determining the concentration or amount in a test sample from a subject of sclerostin;

(b) determining the concentration or amount in a later test sample from the subject of SOST; and (c) comparing the concentration or amount of analyte as determined in step (b) with the concentration or amount of sclerostin determined in step (a), wherein if the concentration or amount determined in step (b) is unchanged or is unfavorable when compared to the concentration or amount of sclerostin determined in step (a), then the disease in the subject is determined to have continued, progressed or worsened. By comparison, if the concentration or amount of sclerostin as determined in step (b) is favorable when compared to the concentration or amount of sclerostin as determined in step (a), then the disease in the subject is determined to have discontinued, regressed or improved.

Optionally, the method further comprises comparing the concentration or amount of sclerostin analyte as determined in step (b), for example, with a predetermined level. Further, optionally the method comprises treating the subject with one or more pharmaceutical compositions for a period of time if the comparison shows that the concentration or amount of analyte as determined in step (b), for example, is unfavorably altered with respect to the predetermined level.

Still further, the methods can be used to monitor treatment in a subject receiving treatment with one or more pharmaceutical compositions. Specifically, such methods involve providing a first test sample from a subject before the subject has been administered one or more pharmaceutical compositions. Next, the concentration or amount in a first test sample from a subject of sclerostin is determined (e.g., using the methods described herein or as known in the art). After the concentration or amount of sclerostin is determined, optionally the concentration or amount of sclerostin is then compared with a predetermined level. If the concentration or amount of sclerostin as determined in the first test sample is lower than the predetermined level, then the subject is not treated with one or more pharmaceutical compositions. However, if the concentration or amount of sclerostin as determined in the first test sample is higher than the predetermined level, then the subject is treated with one or more pharmaceutical compositions for a period of time. The period of time that the subject is treated with the one or more pharmaceutical compositions can be determined by one skilled in the art (for example, the period of time can be from about seven (7) days to about two years, e.g., from about fourteen (14) days to about one (1) year).

During the course of treatment with the one or more pharmaceutical compositions, second and subsequent test samples are then obtained from the subject. The number of test samples and the time in which said test samples are obtained from the subject are not critical. For example, a second test sample could be obtained seven (7) days after the subject is first administered the one or more pharmaceutical compositions, a third test sample could be obtained two (2) weeks after the subject is first administered the one or more pharmaceutical compositions, a fourth test sample could be obtained three (3) weeks after the subject is first administered the one or more pharmaceutical compositions, a fifth test sample could be obtained four (4) weeks after the subject is first administered the one or more pharmaceutical compositions, etc.

After each second or subsequent test sample is obtained from the subject, the concentration or amount of sclerostin analyte is determined in the second or subsequent test sample is determined (e.g., using the methods described herein or as known in the art). The concentration or amount of sclerostin as determined in each of the second and subsequent test samples is then compared with the concentration or amount of analyte as determined in the first test sample (e.g., the test sample that was originally optionally compared to the predetermined level). If the concentration or amount of sclerostin as determined in step (c) is favorable when compared to the concentration or amount of analyte as determined in step (a), then the disease in the subject is determined to have discontinued, regressed or improved, and the subject should continue to be administered the one or pharmaceutical compositions of step (b). However, if the concentration or amount determined in step (c) is unchanged or is unfavorable when compared to the concentration or amount of analyte as determined in step (a), then the disease in the subject is determined to have continued, progressed or worsened, and the subject should be treated with a higher concentration of the one or more pharmaceutical compositions administered to the subject in step (b) or the subject should be treated with one or more pharmaceutical compositions that are different from the one or more pharmaceutical compositions administered to the subject in step (b). Specifically, the subject can be treated with one or more pharmaceutical compositions that are different from the one or more pharmaceutical compositions that the subject had previously received to decrease or lower said subject's analyte level.

Generally, for assays in which repeat testing may be done (e.g., monitoring disease progression and/or response to treatment), a second or subsequent test sample is obtained at a period in time after the first test sample has been obtained from the subject. Specifically, a second test sample from the subject can be obtained minutes, hours, days, weeks or years after the first test sample has been obtained from the subject. For example, the second test sample can be obtained from the subject at a time period of about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5. years, about 6.0 years, about 6.5 years, about 7.0 years, about 7.5 years, about 8.0 years, about 8.5 years, about 9.0 years, about 9.5 years or about 10.0 years after the first test sample from the subject is obtained.

When used to monitor disease progression, the above assay can be used to monitor the progression of disease in subjects suffering from acute conditions. Acute conditions, also known as critical care conditions, refer to acute, life-threatening diseases or other critical medical conditions involving, for example, the cardiovascular system or excretory system. Typically, critical care conditions refer to those conditions requiring acute medical intervention in a hospital-based setting (including, but not limited to, the emergency room, intensive care unit, trauma center, or other emergent care setting) or administration by a paramedic or other field-based medical personnel. For critical care conditions, repeat monitoring is generally done within a shorter time frame, namely, minutes, hours or days (e.g., about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days or about 7 days), and the initial assay likewise is generally done within a shorter timeframe, e.g., about minutes, hours or days of the onset of the disease or condition.

The assays also can be used to monitor the progression of disease in subjects suffering from chronic or non-acute conditions. Non-critical care or, non-acute conditions, refers to conditions other than acute, life-threatening disease or other critical medical conditions involving, for example, the cardiovascular system and/or excretory system. Typically, non-acute conditions include those of longer-term or chronic duration. For non-acute conditions, repeat monitoring generally is done with a longer timeframe, e.g., hours, days, weeks, months or years (e.g., about 1 hour, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5. years, about 6.0 years, about 6.5 years, about 7.0 years, about 7.5 years, about 8.0 years, about 8.5 years, about 9.0 years, about 9.5 years or about 10.0 years), and the initial assay likewise generally is done within a longer time frame, e.g., about hours, days, months or years of the onset of the disease or condition.

Furthermore, the above assays can be performed using a first test sample obtained from a subject where the first test sample is obtained from one source, such as urine, serum or plasma. Optionally, the above assays can then be repeated using a second test sample obtained from the subject where the second test sample is obtained from another source. For example, if the first test sample was obtained from urine, the second test sample can be obtained from serum or plasma. The results obtained from the assays using the first test sample and the second test sample can be compared. The comparison can be used to assess the status of a disease or condition in the subject.

Moreover, the present disclosure also relates to methods of determining whether a subject predisposed to or suffering from a given disease, disorder or condition will benefit from treatment. In particular, the disclosure relates to analyte companion diagnostic methods and products. Thus, the method of "monitoring the treatment of disease in a subject" as described herein further optimally also can encompass selecting or identifying candidates for therapy.

Thus, in particular embodiments, the disclosure also provides a method of determining whether a subject having, or at risk for, a given disease, disorder or condition is a candidate for therapy. Generally, the subject is one who has experienced some symptom of a given disease, disorder or condition or who has actually been diagnosed as having, or being at risk for, a given disease, disorder or condition, and/or who demonstrates an unfavorable concentration or amount of analyte or a fragment thereof, as described herein.

The method optionally comprises an assay as described herein, where SOST is assessed before and following treatment of a subject with one or more pharmaceutical compositions (e.g., particularly with a pharmaceutical related to a mechanism of action involving analyte), with immunosuppressive therapy, or by immunoabsorption therapy, or where analyte is assessed following such treatment and the concentration or the amount of analyte is compared against a predetermined level. An unfavorable concentration of amount of SOST observed following treatment confirms that the subject will not benefit from receiving further or continued treatment, whereas a favorable concentration or amount of analyte observed following treatment confirms that the subject will benefit from receiving further or continued treatment. This confirmation assists with management of clinical studies, and provision of improved patient care.

It goes without saying that, while certain embodiments herein are advantageous when employed to assess a given disease, disorder or condition as discussed herein, the assays and kits can be employed to assess analyte in other diseases, disorders and conditions. The method of assay can also involve the assay of other markers and the like.

The method of assay also can be used to identify a compound that ameliorates a given disease, disorder or condition. For example, a cell that expresses analyte can be contacted with a candidate compound. The level of expression of analyte in the cell contacted with the compound can be compared to that in a control cell using the method of assay described herein.

II. Kits

A kit for assaying a test sample for the presence, amount or concentration of an analyte (or a fragment thereof) in a test sample is also provided. The kit comprises at least one component for assaying the test sample for sclerostin (or a fragment thereof) and instructions for assaying the test sample for the analyte (or a fragment thereof). The at least one component for assaying the test sample for the analyte (or a fragment thereof) can include a composition comprising an anti-sclerostin binding protein, such as a monoclonal antibody or DVD-binding protein (or a fragment, a variant, or a fragment of a variant thereof), as described herein and which is optionally immobilized on a solid phase.

The kit can comprise at least one component for assaying the test sample for an SOST analyte by immunoassay, e.g., chemiluminescent microparticle immunoassay, and instructions for assaying the test sample for an SOST analyte by immunoassay, e.g., chemiluminescent microparticle immunoassay. For example, the kit can comprise at least one specific binding partner for SOST, such as an anti-sclerostin monoclonal/polyclonal antibody (or a fragment thereof that can bind to the SOST analyte, a variant thereof that can bind to the analyte, or a fragment of a variant that can bind to the analyte) or an anti-sclerostin DVD-binding protein (or a fragment, a variant, or a fragment of a variant thereof), either of which can be detectably labeled. Alternatively or additionally, the kit can comprise detectably labeled SOST analyte (or a fragment thereof that can bind to an anti-analyte, monoclonal/polyclonal antibody or an anti-analyte DVD-binding protein (or a fragment, a variant, or a fragment of a variant thereof)), which can compete with any analyte in a test sample for binding to an anti-analyte monoclonal/polyclonal antibody (or a fragment thereof that can bind to the analyte, a variant thereof that can bind to the analyte, or a fragment of a variant that can bind to the analyte) or an anti-analyte DVD-binding protein (or a fragment, a variant, or a fragment of a variant thereof), either of which can be immobilized on a solid support. The kit can comprise a calibrator or control, e.g., isolated or purified analyte. The kit can comprise at least one container (e.g., tube, microtiter plates or strips, which can be already coated with a first specific binding partner, for example) for conducting the assay, and/or a buffer, such as an assay buffer or a wash buffer, either one of which can be provided as a concentrated solution, a substrate solution for the detectable label (e.g., an enzymatic label), or a stop solution. In an embodiment, the kit comprises all components, i.e., reagents, standards, buffers, diluents, etc., which are necessary to perform the assay. The instructions can be in paper form or computer-readable form, such as a disk, CD, DVD, or the like.

Any binding protein, such as an anti-sclerostin binding protein or an anti-analyte DVD-binding protein, or tracer can incorporate a detectable label as described herein, such as a fluorophore, a radioactive moiety, an enzyme, a biotin/avidin label, a chromophore, a chemiluminescent label, or the like, or the kit can include reagents for carrying out detectable labeling. The antibodies, calibrators and/or controls can be provided in separate containers or pre-dispensed into an appropriate assay format, for example, into microtiter plates.

Optionally, the kit includes quality control components (for example, sensitivity panels, calibrators, and positive controls). Preparation of quality control reagents is well-known in the art and is described on insert sheets for a variety of immunodiagnostic products. Sensitivity panel members optionally are used to establish assay performance characteristics, and further optionally are useful indicators of the integrity of the immunoassay kit reagents, and the standardization of assays.

The kit can also optionally include other reagents required to conduct a diagnostic assay or facilitate quality control evaluations, such as buffers, salts, enzymes, enzyme co-factors, enzyme substrates, detection reagents, and the like. Other components, such as buffers and solutions for the isolation and/or treatment of a test sample (e.g., pretreatment reagents), also can be included in the kit. The kit can additionally include one or more other controls. One or more of the components of the kit can be lyophilized, in which case the kit can further comprise reagents suitable for the reconstitution of the lyophilized components.

The various components of the kit optionally are provided in suitable containers as necessary, e.g., a microtiter plate. The kit can further include containers for holding or storing a sample (e.g., a container or cartridge for a urine sample). Where appropriate, the kit optionally also can contain reaction vessels, mixing vessels, and other components that facilitate the preparation of reagents or the test sample. The kit can also include one or more instruments for assisting with obtaining a test sample, such as a syringe, pipette, forceps, measured spoon, or the like.

If the detectable label is at least one acridinium compound, the kit can comprise at least one acridinium-9-carboxamide, at least one acridinium-9-carboxylate aryl ester, or any combination thereof. If the detectable label is at least one acridinium compound, the kit also can comprise a source of hydrogen peroxide, such as a buffer, a solution, and/or at least one basic solution. If desired, the kit can contain a solid phase, such as a magnetic particle, bead, test tube, microtiter plate, cuvette, membrane, scaffolding molecule, film, filter paper, disc or chip.

III. Adaptation of Kit and Method

The kit (or components thereof), as well as the method of determining the presence, amount or concentration of an analyte in a test sample by an assay, such as an immunoassay as described herein, can be adapted for use in a variety of automated and semi-automated systems (including those wherein the solid phase comprises a microparticle, as described, e.g., in U.S. Pat. Nos. 5,089,424 and 5,006,309, and as commercially marketed, e.g., by Abbott Laboratories (Abbott Park, Ill.) as ARCHITECT®.

Some of the differences between an automated or semi-automated system as compared to a non-automated system (e.g., ELISA) include the substrate to which the first specific binding partner (e.g., an anti-analyte, monoclonal/polyclonal antibody (or a fragment thereof, a variant thereof, or a fragment of a variant thereof) or an anti-analyte DVD-binding protein (or a fragment thereof, a variant thereof, or a fragment of a variant thereof) is attached; either way, sandwich formation and analyte reactivity can be impacted), and the length and timing of the capture, detection and/or any optional wash steps. Whereas a non-automated format, such as an ELISA, may require a relatively longer incubation time with sample and capture reagent (e.g., about 2 hours), an automated or semi-automated format (e.g., ARCHITECT®, Abbott Laboratories) may have a relatively shorter incubation time (e.g., approximately 18 minutes for ARCHITECT®). Similarly, whereas a non-automated format, such as an ELISA, may incubate a detection antibody, such as the conjugate reagent, for a relatively longer incubation time (e.g., about 2 hours), an automated or semi-automated format (e.g., ARCHITECT®) may have a relatively shorter incubation time (e.g., approximately 4 minutes for the ARCHITECT®).

Other platforms available from Abbott Laboratories include, but are not limited to, AxSYM®, IMx® (see, e.g., U.S. Pat. No. 5,294,404), PRISM®, EIA (bead), and Quantum™ II, as well as other platforms. Additionally, the assays, kits and kit components can be employed in other formats, for example, on electrochemical or other hand-held or point-of-care assay systems. The present disclosure is, for example, applicable to the commercial Abbott Point of Care (i-STAT®, Abbott Laboratories) electrochemical immunoassay system that performs sandwich immunoassays Immunosensors and their methods of manufacture and operation in single-use test devices are described, for example in, U.S. Pat. No. 5,063,081, US Patent Application Publication No. 2003/0170881, US Patent Application Publication No. 2004/0018577, US Patent Application Publication No. 2005/0054078, and US Patent Application Publication No. 2006/0160164.

In particular, with regard to the adaptation of an analyte assay to the I-STAT® system, the following configuration is exemplary. A microfabricated silicon chip is manufactured with a pair of gold amperometric working electrodes and a silver-silver chloride reference electrode. On one of the working electrodes, polystyrene beads (0.2 mm diameter) with immobilized anti-analyte, monoclonal/polyclonal antibody (or a fragment thereof, a variant thereof, or a fragment of a variant thereof) or anti-analyte DVD-binding protein (or a fragment thereof, a variant thereof, or a fragment of a variant thereof), are adhered to a polymer coating of patterned polyvinyl alcohol over the electrode. This chip is assembled into an I-STAT® cartridge with a fluidics format suitable for immunoassay. On a portion of the wall of the sample-holding chamber of the cartridge there is a layer comprising a specific binding partner for an analyte, such as an anti-analyte, monoclonal/polyclonal antibody (or a fragment thereof, a variant thereof, or a fragment of a variant thereof that can bind the analyte) or an anti-analyte DVD-binding protein (or a fragment thereof, a variant thereof, or a fragment of a variant thereof that can bind the analyte), either of which can be detectably labeled. Within the fluid pouch of the cartridge is an aqueous reagent that includes p-aminophenol phosphate.

In operation, a sample suspected of containing an analyte is added to the holding chamber of the test cartridge, and the cartridge is inserted into the I-STAT® reader. After the specific binding partner for an analyte has dissolved into the sample, a pump element within the cartridge forces the sample into a conduit containing the chip. Here it is oscillated to promote formation of the sandwich. In the penultimate step of the assay, fluid is forced out of the pouch and into the conduit to wash the sample off the chip and into a waste chamber. In the final step of the assay, the alkaline phosphatase label reacts with p-aminophenol phosphate to cleave the phosphate group and permit the liberated p-aminophenol to be electrochemically oxidized at the working electrode. Based on the measured current, the reader is able to calculate the amount of analyte in the sample by means of an embedded algorithm and factory-determined calibration curve.

It further goes without saying that the methods and kits as described herein necessarily encompass other reagents and methods for carrying out the immunoassay. For instance, encompassed are various buffers such as are known in the art and/or which can be readily prepared or optimized to be employed, e.g., for washing, as a conjugate diluent, microparticle diluent, and/or as a calibrator diluent. An exemplary conjugate diluent is ARCHITECT® conjugate diluent employed in certain kits (Abbott Laboratories, Abbott Park, Ill.) and containing 2-(N-morpholino)ethanesulfonic acid (MES), a salt, a protein blocker, an antimicrobial agent, and a detergent. An exemplary calibrator diluent is ARCHITECT® human calibrator diluent employed in certain kits (Abbott Laboratories, Abbott Park, Ill.), which comprises a buffer containing MES, other salt, a protein blocker, and an antimicrobial agent. Additionally, as described in U.S. patent application Ser. No. 12/650,241 (see, also PCT/US2009/069846), improved signal generation may be obtained, e.g., in an I-Stat cartridge format, using a nucleic acid sequence linked to the signal antibody as a signal amplifier.

It will be readily apparent to those skilled in the art that other suitable modifications and adaptations of the methods described herein are obvious and may be made using suitable equivalents without departing from the scope or the embodiments disclosed herein.

Having now described that which is provided in detail, the same will be more clearly understood by reference to the following examples, which are included for purposes of illustration only and are not intended to be limiting.

EXAMPLES

Example 1

Anti-Human SOST Antibodies

Example 1.1

Identification of Fully Human Binding Proteins to Sclerostin by In Vitro Display Systems Example 1.1.1

Antibody Selections

Fully human anti-human sclerostin monoclonal antibodies were isolated by in vitro display technologies from human antibody libraries by their ability to bind recombinant human sclerostin proteins. The amino acid sequences of the variable heavy (VH) and variable light (VL) chains were determined from DNA sequencing.

Example 1.1.2

Affinity Maturation of the Fully Human Anti-Human Sclerostin Binding Protein AE10-6

The AE10-6 human binding protein to human sclerostin was affinity matured by in vitro display technology. Sequence alignment shows that the Sclerostin antibody AE10-6 shares the highest identity to human germlines VH1-24/JH1 and IGKV7-46/JL2. To improve the affinity of AE10-6 to Sclerostin, hypermutated CDR residues were identified from other human antibody sequences in the IgBLAST database that also shared high identity to germlines VH1-24 and IGKV7-46. The corresponding AE10-6 CDR residues were then subjected to limited mutagenesis by PCR with primers having low degeneracy at these positions to create two antibody libraries in the scFv format suitable for surface display. The first library contained mutations at residues 34, 51, 54, 57 and 95 to 100c in the VH CDR1, 2 and 3 (Kabat numbering); the second library at residues 27b, 29, 30, 52, 53, 55 and 91 to 96 in the three VL CDRs. To further increase the identity of AE10-6 to the human germline framework sequences, a binary degeneracy at VH positions 30 (T/S), 50 (G/R) and 52 (D/N) were introduced into the first library. Also, VH position 105 was germlined (P/Q) in the first library. Binary degeneracy at VL positions 24 (K/R), 33 (V/L), 54 (R/L), 55 (H/Q), 56 (T/S), 91 (H/S) and 96 (F/Y) were introduced into the second library. (see table 1). Also, VL position 2 was germlined (T/A) in the second library.

The table below (Table 5) provides a list of amino acid sequences of VH and VL of the fully human AE10-6 binding protein which were subjected to the affinity maturation selection protocol Amino acid residues of individual CDRs of each VH and VL sequence are indicated in bold.

TABLE 5

Amino acid residues found during the affinity maturation of anti-Sclerostin antibody AE10-6.

AE10-6 Heavy chain variable region (SEQ ID NO: 1)

```
SOST            1         2         3         4         5          6
AE10-6 123456789012345678901234567890123456789012345678901 2a345678901
       EVQLVQSGAEVKKPGASVKVSCKVSGYTLTELSMHWVRQAPGKGLEWMGGFDPEDGETIYAQ
                                    SG V                SN    E  I
                                       L                      V  L
                                                              Y  M
                                                              N  N
                                                              G
                                                              A
                                                              R
                                                              Q
                                                              H
                                                              F
                                                              I
                                                            1      1
           7         8         9         0                         1
       23456789012345678901 2abc345678901234567890abcd1234567890123
       KFQGRVTMTEDTSTDTAYMELSSLRSEDTAVYYCATDSEGYWEKYFQHWGPGTLVTVSS
             F          I             M      ETDSF YQF   Q
                                              AV R FI
                                              A N  V
                                              L V
                                              Y S
                                              W P
                                              Q I
                                              N
                                              M
                                              G
```

TABLE 5-continued

Amino acid residues found during the affinity maturation of anti-Sclerostin antibody AE10-6.

AE10-6 Light chain variable region (SEQ ID NO: 2)

```
SOST            1         2         3           4          5
AE10-6 1234567891234567abc890123456789012345678901234567890123456 78
       QAVVTQEPSLTVSPGGTVTLTCGSSTGAVTSGHYPYWFQQKPGQAPRTLISDTNDKHSWT
                           D   IE  T                    FVY DE   Q
                           P   VD                           I    N
                           G   TW                           R    D
                           S   GY                           V
                           N   MN                           T
                           E
                           T
                           H
                                                      1
       6         7         8         9              0
       9012345678901234567890123456789012345678901234 56a
       PARFSGSLLGKAALTLSGAQPEDEAEYYCLLFYGGTVVFGGGTKLTVL
                                    DDRSSL      N
                                    F    NM
                                    N    RF
```

These AE10-6 libraries were transformed and displayed on cell surfaces to be selected against a low concentration of biotinylated Sclerostin by magnetic then fluorescence activated cell sorting. Selections to improve on-rate, off-rate, or both were carried out and antibody protein sequences of affinity-modulated AE10-6 clones were recovered from cells and converted back to IgG format for further characterization.

The tables below provides a list of amino acid sequences of VH (Table 6) and VL (Table 7) regions of affinity matured fully human Sclerostin antibodies derived from AE10-6. Amino acid residues of individual CDRs of each VH sequence are indicated in bold

TABLE 6

VH sequences of affinity matured AE10-6 variants

| Clone | SEQ ID NO: | VH |
|---|---|---|
| HC-38 | SEQ ID NO: 1719 | EVQLVQSGAEVKKPGASVKVSCKVSGYTLSELSMHWVRQAPGKGLEWMGGFDPEVGELIYAQKFQGRVTMTEDTSTDTAYMELSSLRSEDTAVYYCATDAGGFWYKFFQHWGPGTLVTVSS |
| HC-41 | SEQ ID NO: 1720 | EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATNSEGYWWKDFQHWGPGTLVTVSS |
| HC-42 | SEQ ID NO: 1721 | EVQLVQSGAEVKKPGASVKVSCKVSGYTLSELSIHWVRQAPGKGLEWMGGFDPEEGEIIYAQKFQGRVTMTEDTSTDTAYMELSSLRSEDTAVYYCATDSAGYWYKFFQHWGPGTLVTVSS |
| HC-47 | SEQ ID NO: 1722 | EVQLVQSGAEVKKPGASVKVSCKVSGYTLTELSMHWVRQAPGKGLEWMGGFDPEAGETIYAQKFQGRVTMTEDTSTDTAYMELSSLRSEDTAVYYCATDGELYWYKFFQHWGPGTLVTVSS |
| HC-48 | SEQ ID NO: 1723 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDAGGYWYKFFQHWGPGTLVTVSS |
| HC-5 | SEQ ID NO: 1724 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDAAGYWYKFFQHWGPGTLVTVSS |
| HC-77 | SEQ ID NO: 1725 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSAGFWYKFFQHWGPGTLVTVSS |
| HC-S1 | SEQ ID NO: 1726 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSEGYWEKFFQHWGPGTLVTVSS |
| HC-S10 | SEQ ID NO: 1727 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTVGRWEKYFQHWGPGTLVTVSS |

TABLE 6-continued

VH sequences of affinity matured AE10-6 variants

| Clone | SEQ ID NO: | VH |
|---|---|---|
| HC-S11 | SEQ ID NO: 1728 | EVQLVQSGAEVKKPGASVKVSCKVSGYTLSELSVHWVRQAPGKGLEWMGGFDPEYGETIYAQKFQGRVTMTEDTSTDTAYMELSSLRSEDTAVYYCATDTMGYWEKYFQHWGPGTLVTVSS |
| HC-S12 | SEQ ID NO: 1729 | EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDSDGYWEKFFQHWGPGTLVTVSS |
| HC-S14 | SEQ ID NO: 1730 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSYGYWEKFFQHWGPGTLVTVSS |
| HC-S15 | SEQ ID NO: 1731 | EVQLVQSGAEVKKPGASVKVSCKVSGYTLTELSMHWVRQAPGKGLEWMGGFDPENGETIYAQKFQGRVTMTEDTSTDTAYMELSSLRSEDTAVYYCATDTAGYWEKFFQHWGPGTLVTVSS |
| HC-S16 | SEQ ID NO: 1732 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGVWEKYFQHWGPGTLVTVSS |
| HC-S17 | SEQ ID NO: 1733 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDSDGFWEKFFQHWGPGTLVTVSS |
| HC-S18 | SEQ ID NO: 1734 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSVGYWEKFFQHWGPGTLVTVSS |
| HC-S19 | SEQ ID NO: 1735 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTVGYWEKFFQHWGPGTLVTVSS |
| HC-S2 | SEQ ID NO: 1736 | EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSVGYWEKFFQHWGPGTLVTVSS |
| HC-S21 | SEQ ID NO: 1737 | EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDTVGNWEKFFQHWGPGTLVTVSS |
| HC-S23 | SEQ ID NO: 1738 | EVQLVQSGAEVKKPGASVKVSCKVSGYTLSELSMHWVRQAPGKGLEWMGGFDPEDGELIYAQKFQGRVTMTEDTSTDTAYMELSSLRSEDTAVYYCATDTDGYWEKYFQHWGPGTLVTVSS |
| HC-S24 | SEQ ID NO: 1739 | EVQLVQSGAEVKKPGASVKVSCKVSGYTLSELSMHWVRQAPGKGLEWMGGFDPEYGETIYAQKFQGRVTMTEDTSTDTAYMELSSLRSEDTAVYYCATDSDGYWEKYFQHWGPGTLVTVSS |
| HC-S25 | SEQ ID NO: 1740 | EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDSDSYWEKFFQHWGPGTLVTVSS |
| HC-S26 | SEQ ID NO: 1741 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSDGYWEKFFQHWGPGTLVTVSS |
| HC-S27 | SEQ ID NO: 1742 | EVQLVQSGAEVKKPGASVKVSCKVSGYTLSGLSMHWVRQAPGKGLEWMGGFDPEEGETIYAQKFQGRVTMTEDTSTDTAYMELSSLRSEDTAVYYCATDSWGYWEKFFQHWGPGTLVTVSS |
| HC-S29 | SEQ ID NO: 1743 | EVQLVQSGAEVKKPGASVKVSCKVSGYTLSELSVHWVRQAPGKGLEWMGGFDPEEGETIYAQKFQGRVTMTEDTSTDTAYMELSSLRSEDTAVYYCATDSAGSWYKFFQHWGPGTLVTVSS |
| HC-S30 | SEQ ID NO: 1744 | EVQLVQSGAEVKKPGASVKVSCKVSGYTLSELSVHWVRQAPGKGLEWMGGFDPENGEIIYAQKFQGRVTMTEDTSTDTAYMELSSLRSEDTAVYYCATDSDGFWEKFFQHWGPGTLVTVSS |
| HC-S31 | SEQ ID NO: 1745 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSQGYWYKFFQHWGPGTLVTVSS |
| HC-S32 | SEQ ID NO: 1746 | EVQLVQSGAEVKKPGASVKVSCKVSGYTLSELSMHWVRQAPGKGLEWMGGFDPEQGETIYAQKFQGRVTMTEDTSTDTAYMELSSLRSEDTAVYYCATDADGYWEKFFQHWGPGTLVTVSS |

TABLE 6-continued

VH sequences of affinity matured AE10-6 variants

| Clone | SEQ ID NO: | VH |
|---|---|---|
| HC-S34 | SEQ ID NO: 1747 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSVGRWYKFFQHWGPGTLVTVSS |
| HC-S36 | SEQ ID NO: 1748 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTEGYWFKYFQHWGPGTLVTVSS |
| HC-S38 | SEQ ID NO: 1749 | EVQLVQSGAEVKKPGASVKVSCKVSGYTLSELSMHWVRQAPGKGLEWMGGFDPEEGEMIYAQKFQGRVTMTEDTSTDTAYMELSSLRSEDTAVYYCATESEGFWFKYFQHWGPGTLVTVSS |
| HC-S39 | SEQ ID NO: 1750 | EVQLVQSGAEVKKPGASVKVSCKVSGYTLTELSMHWVRQAPGKGLEWMGGFDPEYGETIYAQKFQGRVTMTEDTSTDTAYMELSSLRSEDTAVYYCATDSVSYWEKYFQHWGPGTLVTVSS |
| HC-S40 | SEQ ID NO: 1751 | EVQLVQSGAEVKKPGASVKVSCKVSGYTLSELSMHWVRQAPGKGLEWMGGFDPENGETIYAQKFQGRVTMTEDTSTDTAYMELSSLRSEDTAVYYCATDSDGYWEKFFQHWGPGTLVTVSS |
| HC-S41 | SEQ ID NO: 1752 | EVQLVQSGAEVKKPGASVKVSCKVSGYTLSELSMHWVRQAPGKGLEWMGGFDPEDGELIYAQKFQGRVTMTEDTSTDTAYMELSSLRSEDTAVYYCATDTEGYWEKYFQHWGPGTLVTVSS |
| HC-S42 | SEQ ID NO: 1753 | EVQLVQSGAEVKKPGASVKVSCKVSGYTLSELSLHWVRQAPGKGLEWMGGFNPEDGETIYAQKFQGRVTMTEDTSTDTAYMELSSLRSEDTAVYYCATDSEGYWVKYFQHWGPGTLVTVSS |
| HC-S44 | SEQ ID NO: 1754 | EVQLVQSGAEVKKPGASVKVSCKVSGYTLSELSMHWVRQAPGKGLEWMGGFDPENGETIYAQKFQGRVTMTEDTSTDTAYMELSSLRSEDTAVYYCATDSEGYWEKFFQHWGPGTLVTVSS |
| HC-S45 | SEQ ID NO: 1755 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSDGYWEKFFQHWGPGTLVTVSS |
| HC-S46 | SEQ ID NO: 1756 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTLGYWEKFFQHWGPGTLVTVSS |
| HC-S48 | SEQ ID NO: 1757 | EVQLVQSGAEVKKPGASVKVSCKVSGYTLSELSMHWVRQAPGKGLEWMGGFDPEDGENIYAQKFQGRVTMTEDTSTDTAYMELSSLRSEDTAVYYCATDSDGYWFKYFQHWGPGTLVTVSS |
| HC-S5 | SEQ ID NO: 1758 | EVQLVQSGAEVKKPGASVKVSCKVSGYTLSELSMHWVRQAPGKGLEWMGGFDPEEGEMIYAQKFQGRVTMTEDTSTDTAYMELSSLRSEDTAVYYCATDSDGYWEKFFQHWGPGTLVTVSS |
| HC-S50 | SEQ ID NO: 1759 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSNGYWEKFFQHWGPGTLVTVSS |
| HC-S51 | SEQ ID NO: 1760 | EVQLVQSGAEVKKPGASVKVSCKVSGYTLSGLSMHWVRQAPGKGLEWMGGFDPEDGETIYAQKFQGRVTMTEDTSTDTAYMELSSLRSEDTAVYYCATDSEGYWEKFFQHWGPGTLVTVSS |
| HC-S52 | SEQ ID NO: 1761 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSAGYWYQFFQHWGPGTLVTVSS |
| HC-S53 | SEQ ID NO: 1762 | EVQLVQSGAEVKKPGASVKVSCKVSGYTLSELSMHWVRQAPGKGLEWMGGFDPEVGEIIYAQKFQGRVTMTEDTSTDTAYMELSSLRSEDTAVYYCATDSEGFWFKYFQHWGPGTLVTVSS |
| HC-S54 | SEQ ID NO: 1763 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDTDGYWEKFFQHWGPGTLVTVSS |
| HC-S55 | SEQ ID NO: 1764 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSEGYWEKFFQHWGPGTLVTVSS |
| HC-S56 | SEQ ID NO: 1765 | EVQLVQSGAEVKKPGASVKVSCKVSGYTLSELSLHWVRQAPGKGLEWMGGFDPEAGETIYAQKFQGRVTMTEDTSTDTAYMELSSLRSEDTAVYYCATDSAGFWYKYFQHWGPGTLVTVSS |

TABLE 6-continued

VH sequences of affinity matured AE10-6 variants

| Clone | SEQ ID NO: | VH |
|---|---|---|
| HC-S57 | SEQ ID NO: 1766 | EVQLVQSGAEVKKPGASVKVSCKVSGYTLSELSMHWVRQAPGKGLEWMGGFDPEAGENIYAQKFQGRVTMTEDTSTDTAYMELSSLRSEDTAVYYCATDSEGYWVKFFQHWGPGTLVTVSS |
| HC-S58 | SEQ ID NO: 1767 | EVQLVQSGAEVKKPGASVKVSCKVSGYTLSELSMHWVRQAPGKGLEWMGGFDPEVGELIYAQKFQGRVTMTEDTSTDTAYMELSSLRSEDTAVYYCATDTDGYWEKYFQHWGPGTLVTVSS |
| HC-S59 | SEQ ID NO: 1768 | EVQLVQSGAEVKKPGASVKVSCKVSGYTLSELSMHWVRQAPGKGLEWMGGFDPEAGETIYAQKFQGRVTMTEDTSTDTAYMELSSLRSEDTAVYYCATDSEGYWYKFFQHWGPGTLVTVSS |
| HC-S6 | SEQ ID NO: 1769 | EVQLVQSGAEVKKPGASVKVSCKVSGYTLSELSMHWVRQAPGKGLEWMGGFDPEGGENIYAQKFQGRVTMTEDTSTDTAYMELSSLRSEDTAVYYCATDSDGYWEKFFQHWGPGTLVTVSS |
| HC-S63 | SEQ ID NO: 1770 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGYWYKFFQHWGPGTLVTVSS |
| HC-S64 | SEQ ID NO: 1771 | EVQLVQSGAEVKKPGASVKVSCKVSGYTLSELSVHWVRQAPGKGLEWMGGFDPEEGETIYAQKFQGRVTMTEDTSTDTAYMELSSLRSEDTAVYYCATDSDGYWEKFFQHWGPGTLVTVSS |
| HC-S65 | SEQ ID NO: 1772 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTVGNWEKFFQHWGPGTLVTVSS |
| HC-S66 | SEQ ID NO: 1773 | EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSEGYWEKFFQHWGPGTLVTVSS |
| HC-S67 | SEQ ID NO: 1774 | EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSDGYWEKFFQHWGPGTLVTVSS |
| HC-S69 | SEQ ID NO: 1775 | EVQLVQSGAEVKKPGASVKVSCKVSGYTLSELSLHWVRQAPGKGLEWMGGFDPEHGETIYAQKFQGRVTMTEDTSTDTAYMELSSLRSEDTAVYYCATDSLGYWYKFFQHWGPGTLVTVSS |
| HC-S7 | SEQ ID NO: 1776 | EVQLVQSGAEVKKPGASVKVSCKVSGYTLSELSMHWVRQAPGKGLEWMGGFDPEYGEIIYAQKFQGRVTMTEDTSTDTAYMELSSLRSEDTAVYYCATDSAGYWEKYFQHWGPGTLVTVSS |
| HC-S71 | SEQ ID NO: 1777 | EVQLVQSGAEVKKPGASVKVSCKVSGYTLSELSMHWVRQAPGKGLEWMGGFDPEDGEMIYAQKFQGRVTMTEDTSTDTAYMELSSLRSEDTAVYYCATDSEGYWEKYFQHWGPGTLVTVSS |
| HC-S72 | SEQ ID NO: 1778 | EVQLVQSGAEVKKPGASVKVSCKVSGYTLSELSVHWVRQAPGKGLEWMGGFDPEAGEIIYAQKFQGRVTMTEDTSTDTAYMELSSLRSEDTAVYYCATDSAGYWYKYFQHWGPGTLVTVSS |
| HC-S74 | SEQ ID NO: 1779 | EVQLVQSGAEVKKPGASVKVSCKVSGYTLTELSMHWVRQAPGKGLEWMGGFDPEEGETIYAQKFQGRVTMTEDTSTDTAYMELSSLRSEDTAVYYCATDSEGYWEKFFQHWGPGTLVTVSS |
| HC-S75 | SEQ ID NO: 1780 | EVQLVQSGAEVKKPGASVKVSCKVSGYTLSELSLHWVRQAPGKGLEWMGGSDPEEGETIYAQKFQGRVTMTEDTSTDTAYMELSSLRSEDTAVYYCATDSAGYWFKYFQHWGPGTLVTVSS |
| HC-S76 | SEQ ID NO: 1781 | EVQLVQSGAEVKKPGASVKVSCKVSGYTLTELSMHWVRQAPGKGLEWMGGFDPEVGEIIYAQKFQGRVTMTEDTSTDTAYMELSSLRSEDTAVYYCATDSAGYWYKYFQHWGPGTLVTVSS |
| HC-S78 | SEQ ID NO: 1782 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSEGPWYKFFQHWGPGTLVTVSS |
| HC-S79 | SEQ ID NO: 1783 | EVQLVQSGAEVKKPGASVKVSCKVSGYTLTELSMHWVRQAPGKGLEWMGGFDPERGETIYAQKFQGRVTMTEDTSTDTAYMELSSLRSEDTAVYYCATDSAGYWYKFFQHWGPGTLVTVSS |
| HC-S8 | SEQ ID NO: 1784 | EVQLVQSGAEVKKPGASVKVSCKVSGYTLSELSMHWVRQAPGKGLEWMGGFDPEDGELIYAQKFQGRVTMTEDTSTDTAYMELSSLRSEDTAVYYCATDSEGFWFKYFQHWGPGTLVTVSS |

TABLE 6-continued

VH sequences of affinity matured AE10-6 variants

| Clone | SEQ ID NO: | VH |
|---|---|---|
| HC-S80 | SEQ ID NO: 1785 | EVQLVQSGAEVKKPGASVKVSCKVSGYTLSELSMHWVRQAPGKGLEWMGGFDPEDGEMIYAQKFQGRVTMTEDTSTDTAYMELSSLRSEDTAVYYCATDSDGYWEKFFQHWGPGTLVTVSS |
| HC-S81 | SEQ ID NO: 1786 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSAGYWYKFFQHWGPGTLVTVSS |
| HC-S83 | SEQ ID NO: 1787 | EVQLVQSGAEVKKPGASVKVSCKVSGYTLTELSMHWVRQAPGKGLEWMGGFDPEEGETIYAQKFQGRVTMTEDTSTDTAYMELSSLRSEDTAVYYCATDSDGYWEKFFQHWGPGTLVTVSS |
| HC-S87 | SEQ ID NO: 1788 | EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDTVGYWEKFFQHWGPGTLVTVSS |
| HC-S89 | SEQ ID NO: 1789 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGYWEKFFQHWGPGTLVTVSS |
| HC-S9 | SEQ ID NO: 1790 | EVQLVQSGAEVKKPGASVKVSCKVSGYTLSELSMHWVRQAPGKGLEWMGGFDPEFGETIYAQKFQGRVTMTEDTSTDTAYMELSSLRSEDTAVYYCATDTDGYWEKFFQHWGPGTLVTVSS |
| HC-S90 | SEQ ID NO: 1791 | EVQLVQSGAEVKKPGASVKVSCKVSGYTLSELSMHWVRQAPGKGLEWMGGFDPEYGELIYAQKFQGRVTMTEDTSTDTAYMELSSLRSEDTAVYYCATDSDGYWEKYFQHWGPGTLVTVSS |
| HC-S92 | SEQ ID NO: 1792 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSDGIWEKFFQHWGPGTLVTVSS |
| HC-S94 | SEQ ID NO: 1793 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDSDGYWEKFFQHWGPGTLVTVSS |
| HC-S95 | SEQ ID NO: 1794 | EVQLVQSGAEVKKPGASVKVSCKVSGYTLSELSMHWVRQAPGKGLEWMGGFDPEAGEIIYAQKFQGRVTMTEDTSTDTAYMELSSLRSEDTAVYYCATDSAGYWYKYFQHWGPGTLVTVSS |
| rHC + LC-1 | SEQ ID NO: 1795 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDTDGYWEKFFQHWGQGTLVTVSS |
| rHC + LC-100 | SEQ ID NO: 1796 | EVQLVQSGAEVKKPGASVKVSCKVSGYTLSELSMHWVRQAPGKGLEWMGGFDPEEGEIIYAQKFQGRVTMTEDTSTDTAYMELSSLRSEDTAVYYCATDTVGYWEKFFQHWGQGTLVTVSS |
| rHC + LC-109 | SEQ ID NO: 1797 | EVQLVQSGAEVKKPGASVKVSCKVSGYTLSELSMHWVRQAPGKGLEWMGGFDPEYGELIYAQKFQGRVTMTEDTSTDTAYMELSSLRSEDTAVYYCATDTDGYWEKYFQHWGQGTLVTVSS |
| rHC + LC-113 | SEQ ID NO: 1798 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDAGGYWYKFFQHWGQGTLVTVSS |
| rHC + LC-143 | SEQ ID NO: 1799 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSAGYWYKFFQHWGQGTLVTVSS |
| rHC + LC-149 | SEQ ID NO: 1800 | EVQLVQSGAEVKKPGASVKVSCKVSGYTLTELSMHWVRQAPGKGLEWMGGFDPEAGETIYAQKFQGRVTMTEDTSTDTAYMELSSLRSEDTAVYYCATDGELYWYKFFQHWGQGTLVTVSS |
| rHC + LC-21 | SEQ ID NO: 1801 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDTEGYWEKFFQHWGQGTLVTVSS |
| rHC + LC-26 | SEQ ID NO: 1802 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSDGYWEKFFQHWGQGTLVTVSS |
| rHC + LC-43 | SEQ ID NO: 1803 | EVQLVQSGAEVKKPGASVKVSCKVSGYTLTELSMHWVRQAPGKGLEWMGGFDPEHGETIYAQKFQGRVTMTEDTSTDTAYMELSSLRSEDTAVYYCATDSVSFWEKFFQHWGQGTLVTVSS |

TABLE 6-continued

VH sequences of affinity matured AE10-6 variants

| Clone | SEQ ID NO: | VH |
|---|---|---|
| rHC + LC-52 | SEQ ID NO: 1804 | EVQLVQSGAEVKKPGASVKVSCKVSGYTLSELSTHWVRQAPGKGLEWMGGFDPEYGEIIYAQKFQGRVTMTEDTSTDTAYMELSSLRSEDTAVYYCATDTVGNWYKFFQHWGQGTLVTVSS |
| rHC + LC-60 | SEQ ID NO: 1805 | EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDTQGYWEKFFQHWGQGTLVTVSS |
| rHC + LC-66 | SEQ ID NO: 1806 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSS |
| rHC + LC-69 | SEQ ID NO: 1807 | EVQLVQSGAEVKKPGASVKVSCKVSGYTLSELSIHWVRQAPGKGLEWMGGFDPEDGETIYAQKFQGRVTMTEDTSTDTAYMELSSLRSEDTAVYYCATDSAGYWYKFFQHWGQGTLVTVSS |
| rHC + LC-82 | SEQ ID NO: 1808 | EVQLVQSGAEVKKPGASVKVSCKVSGYTLSELSMHWVRQAPGKGLEWMGGFDPEVGELIYAQKFQGRVTMTEDTSTDTAYMELSSLRSEDTAVYYCATDTDGYWEKFFQHWGQGTLVTVSS |
| rHC + LC-83 | SEQ ID NO: 1809 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTAGNWYKFFQHWGQGTLVTVSS |
| rHC + LC-87 | SEQ ID NO: 1810 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSAGYWYKFFQHWGQGTLVTVSS |
| rHC + LC-93 | SEQ ID NO: 1811 | EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDTDGYWEKFFQHWGQGTLVTVSS |
| rHC + LC-94 | SEQ ID NO: 1812 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGYWEKFFQHWGQGTLVTVSS |
| rHC + LC-99 | SEQ ID NO: 1813 | EVQLVQSGAEVKKPGASVKVSCKVSGYTLSELSLHWVRQAPGKGLEWMGGFDPEDGETIYAQKFQGRVTMTEDTSTDTAYMELSSLRSEDTAVYYCATDSLGYWYKFFQHWGQGTLVTVSS |
| rHC + LC-A1 | SEQ ID NO: 1814 | EVQLVQSGAEVKKPGASVKVSCKVSGYTLTELSMHWVRQAPGKGLEWMGGFDPEEGETIYAQKFQGRVNMTEDTSTDTAYMELSSLRSEDTAVYYCATNSEGYWWKDFQHWGQGTLVTVSS |
| rHC + LC-A10 | SEQ ID NO: 1815 | EVQLVQSGAEVKKPGASVKVSCKVSGYTLSELSMHWVRQAPGKGLEWMGGFDPEGGEIIYAQKFQGRVTMTEDTSTDTAYMELSSLRSEDTAVYYCATNSDGYWWKDFQHWGQGTLVTVSS |
| rHC + LC-A2 | SEQ ID NO: 1816 | EVQLVQSGAEVKKPGASVKVSCKVSGYTLSELSMHWVRQAPGKGLEWMGGFDPENGETIYAQKFQGRVTMTEDTSTDTAYMELSSLRSEDTAVYYCATDSDGYWEKFFQHWGQGTLVTVSS |
| rHC + LC-A7 | SEQ ID NO: 1817 | EVQLVQSGAEVKKPGASVKVSCKVSGYTLTELSMHWVRQAPGKGLEWMGGFDPEGGETIYAQKFQGRVTMTEDTSTDTAYMELSSLRSEDTAVYYCATDSGGYWYKFFQHWGQGTLVTVSS |
| rHC + LC-A8 | SEQ ID NO: 1818 | EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDSDGYWEKFFQHWGQGTLVTVSS |
| rHC + LC-B12 | SEQ ID NO: 1819 | EVQLVQSGAEVKKPGASVKVSCKVSGYTLSELSMHWVRQAPGKGLEWMGGFDPEGGELIYAQKFQGRVTMTEDTSTDTAYMELSSLRSEDTAVYYCATDSEGYWEKFFQHWGQGTLVTVSS |
| rHC + LC-B2 | SEQ ID NO: 1820 | EVQLVQSGAEVKKPGASVKVSCKVSGYTLTELSMHWVRQAPGKGLEWMGGFDPEGGETIYAQKFQGRVTMTEDTSTDTAYMELSSLRSEDTAVYYCATDSDGYWEKFFQHWGQGTLVTVSS |
| rHC + LC-B6 | SEQ ID NO: 1821 | EVQLVQSGAEVKKPGASVKVSCKVSGYSLSELSMHWVRQAPGKGLEWMGGFDPEVGEIIYAQKFQGRVTMTEDTSTDTAYMELSSLRSEDTAVYYCATDSAGYWYKYFQHWGQGTLVTVSS |
| rHC + LC-B9 | SEQ ID NO: 1822 | EVQLVQSGAEVKKPGASVKVSCKVSGYTLSELSMHWVRQAPGKGLEWMGGFDPENGETIYAQKFQGRVTMTEDTSTDTAYMELSSLRSEDTAVYYCATDTEGYWEKFFQHWGQGTLVTVSS |

TABLE 6-continued

VH sequences of affinity matured AE10-6 variants

| Clone | SEQ ID NO: | VH |
|---|---|---|
| rHC + LC-C12 | SEQ ID NO: 1823 | EVQLVQSGAEVKKPGASVKVSCKVSGYTLSELSMHWVRQAPGKGLEWMGGFDPEEGEIIYAQKFQGRVTMTEDTSTDTAYMELSSLRSEDTAVYYCATDSVGYWEKFFQHWGQGTLVTVSS |
| rHC + LC-C4 | SEQ ID NO: 1824 | EVQLVQSGAEVKKHGASVKVSCKVSGYTLSELSMHWVRQAPGKGLEWMGGFDPEDGEIIYAQKFQGRVTMTEDTSTDTAYMELSSLRSEDTAVYYCATDSEGYWEKFFQHWGQGTLVTVSS |
| rHC + LC-C6 | SEQ ID NO: 1825 | EVQLVQSGAEVKKPGASVKVSCKVSGYTLSELSMHWVRQAPGKGLEWMGGFDPEEGETIYAQKFQGRVTMTEDTSTDTAYMELSSLRSEDTAMYYCATDSDGYWEKFFQHWGPGTLVTVSS |
| rHC + LC-C7 | SEQ ID NO: 1826 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSDGYWEKFFQHWGQGTLVTVSS |
| rHC + LC-C9 | SEQ ID NO: 1827 | EVQLVQSGAEVKKPGASVKVSCKVSGYTLSELSVHWVRQAPGKGLEWMGGFDPEDGEVIYAQKFQGRVTMTEDTSTDTAYMELSSLRSEDTAVYYCATDSAGYWYKFFQHWGQGTLVTVSS |
| rHC + LC-D1 | SEQ ID NO: 1828 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDSEGYWEKFFQHWGQGTLVTVSS |
| rHC + LC-D10 | SEQ ID NO: 1829 | EVQLVQSGAEVKKPGASVKVSCKVSGYTLTELSMHWVRQAPGKGLEWMGGFDPEEGETIYAQKFQGRVTMTEDTSTDTAYMELSSLRSEDTAVYYCATDSDGYWEKFFQHWGQGTLVTVSS |
| rHC + LC-D11 | SEQ ID NO: 1830 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATNSDGYWEKYFQHWGQGTLVTVSS |
| rHC + LC-D12 | SEQ ID NO: 1831 | EVQLVQSGAEVKKPGASVKVSCKVSGYTLSELSMHWVRQAPGKGLEWMGGFDPEAGETIYAQKFQGRVTMTEDTSTDTAYMELSSLRSEDTAVYYCATDSDGYWEKFFQHWGQGTLVTVSS |
| rHC + LC-D2 | SEQ ID NO: 1832 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTEGYWEKFFQHWGQGTLVTVSS |
| rHC + LC-D4 | SEQ ID NO: 1833 | EVQLVQSGAEVKKPGASVKVSCKVSGYTLSELSIHWVRQAPGKGLEWMGGFDPEEGEIIYAQKFQGRVTMTEDTSTDTAYMELSSLRSEDTAVYYCATDSAGYWYKFFQHWGQGTLVTVSS |
| rHC + LC-D5 | SEQ ID NO: 1834 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTDGYWEKFFQHWGQGTLVTVSS |
| rHC + LC-D6 | SEQ ID NO: 1835 | EVQLVQSGAEVKKPGASVKVSCKVSGYTLSELSMHWVRQAPGKGLEWMGGFDPEDGETIYAQKFEGRVTMTEDTSTDTAYMELSSLRSEDTAVYYCATDSDGYWEKFFQHWGQGTLVTVSS |
| rHC + LC-D7 | SEQ ID NO: 1836 | EVQLVQSGAEVKKPGASVKVSCKVSGYTLTELSMHWVRQAPGKGLEWMGGFDPEDGEIIYAQKFQGRVTMTEDTSTDTAYMELSSLRSEDTAVYYCATDSEGYWEKFFQHWGQGTLVTVSS |
| rHC + LC-D8 | SEQ ID NO: 1837 | EVQLVQSGAEVKKPGASVKVSCKVSGYTLSELSMHWVRQAPGKGLEWMGGFDPEYGETIYAQKFQGRVTMTEDTSTDTAYMELSSLRSEDTAVYYCATDSDGYWEKFFQHWGQGTLVTVSS |
| rHC + LC-E1 | SEQ ID NO: 1838 | EVQLVQSGAEVKKPGASVKVSCKVSGYTLSELSMHWVRQAPGKGLEWMGGFDPEAGETIYAQKFQGRVTMTEDTSTDTAYMELSSLRSEDTAVYYCATDSEGYWEKFFQHWGQGTLVTVSS |
| rHC + LC-E10 | SEQ ID NO: 1839 | EVQLVQSGAEVKKPGASVKVSCKVSGYTLSELSMHWVRQAPGKGLEWMGGFDPEDGELIYAQKFQGRVTMTEDTSTDTAYMELSSLGSEDTAVYYCATNSAGYWWKDFQHWGQGTLVTVSS |
| rHC + LC-E11 | SEQ ID NO: 1840 | EVQLVQSGAEVKKPGASVKVSCKVSGYTLSELSVHWVRQAPGKGLEWMGGFDPENGEIIYAQKFQGRVTMTEDTSTDTAYMELSSLRSEDTAVYYCATDSDGFWEKFFQHWGQGTLVTVSS |
| rHC + LC-E4 | SEQ ID NO: 1841 | EVQLVQSGAEVKKPGASVKVSCKVSGYTLTELSMHWVRQAPGKGLEWMGGFDPEEGELIYAQKFQGRVTMTEDTSTDTAYMELSSLRSEDTAVYYCATDSDGYWEKFFQHWGQGTLVTVSS |

TABLE 6-continued

VH sequences of affinity matured AE10-6 variants

| Clone | SEQ ID NO: | VH |
|---|---|---|
| rHC + LC-E6 | SEQ ID NO: 1842 | EVQLVQSGAEVMKPGASVKVSCKVSGYTLTELSMHWVRQAPGKGLEWMGGFDPEYGETIYAQKFQGRVTMTEDTSTDTAYMELSSLRSEDTAVYYCATDTVGYWEKFFQHWARGTLVTVSS |
| rHC + LC-E9 | SEQ ID NO: 1843 | EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSDGYWEKFFQHWGQGTLVTVSS |
| rHC + LC-F1 | SEQ ID NO: 1844 | EVQLVQSGAEVKKPGASVKVSCKVSGYTLTELSMHWVRQAPGKGLEWMGGFDPEVGETIYAQKFQGRVTMTEDTSTDTAYMELSSLRSEDTAVYYCATDSDGYWEKFFQHWGQGTLVTVSS |
| rHC + LC-F12 | SEQ ID NO: 1845 | EVQLVQSGAEVKKPGASVKVSCKVSGYTISELSMHWVRQAPGKGLEWMGGFDPEVGEIIYAQKFQGRVTMTEDTSTDTAYMELSSLRSEDTAVYYCATDSEGYWEKFFQHWGQGTLVTVSS |
| rHC + LC-F3 | SEQ ID NO: 1846 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSDGFWEKFFQHWGQGTLVTVSS |
| rHC + LC-F4 | SEQ ID NO: 1847 | EVQLVQSGAEVKKPGASVKVSCKVSGYTLSELSVHWVRQAPGKGLEWMGGFDPEDGEIIYAQKFQGRVTMTEDTSTDTAYMELSSLRSEDTAVYYCATDTDGYWEKFFQHWGQGTLVTVSS |
| rHC + LC-F5 | SEQ ID NO: 1848 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSAGFWYKFFQHWGQGTLVTVSS |
| rHC + LC-F6 | SEQ ID NO: 1849 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDSDGYWEKFFQHWGQGTLVTVSS |
| rHC + LC-F7 | SEQ ID NO: 1850 | EVQLVQSGAEVKKPGASVKVSCKVSGYTLSELSIHWVRQAPGKGLEWMGGFDPENGEIIYAQKFQGRVTMTEDTSTDTAYMELSSLRSEDTAVYYCATDSDGYWEKFFQHWGQGTLVTVSS |
| rHC + LC-G1 | SEQ ID NO: 1851 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSVGRWYKFFQHWGQGTLVTVSS |
| rHC + LC-G11 | SEQ ID NO: 1852 | EVQLVQSGAEVKKPGASVKVSCKVSGYTLSELSMHWVRQAPGKGLEWMGGFDPEYGETIYAQKFQGRVTMTEDTSTDTAYMELSSLRSEDTAVYYCATDTVGYWEKFFQHWGQGTLVTVSS |
| rHC + LC-G12 | SEQ ID NO: 1853 | EVQLVQSGAEVKKPGASVKVSCKVSGYTLSELSMHWVRQAPGKGLEWMGGFDPEVGEIIYAQKFQGRVTMTEDTSTDTAYMELSSLRSEDTAVYYCATDSDGYWEKFFQHWGQGTLVTVSS |
| rHC + LC-G2 | SEQ ID NO: 1854 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDTDGYWEKFFQHWGQGTLVTVSS |
| rHC + LC-G4 | SEQ ID NO: 1855 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSVGRWYKFFQHWGQGTLVTVSS |
| rHC + LC-G6 | SEQ ID NO: 1856 | EVQLVQSGAEVKKPGASVKVSCKVSGYTLTELSMHWVRQAPGKGLEWMGGFDPEYGEIIYAQKFQGRVTMTEDTSTDTAYMELSSLRSEDTAVYYCATDTEGYWEKFFQHWGQGTLVTVSS |
| rHC + LC-G7 | SEQ ID NO: 1857 | EVQLVQSGAEVKKPGASVKVSCKVSGYTLSELSVHWVRQAPGKGLEWMGGLDPEDGETIYAQKFQGRVTMTEDTSTDTAYMELSSLRSEDTAVYYCATESVGYWYKFFQHWGQGTLVTVSS |
| rHC + LC-G8 | SEQ ID NO: 1858 | EVQLVQSGAEVKKPGASVKVSCKVSGYTLTELSMHWVRQAPGKGLEWMGGFDPEGGETIYAQKFQGRVTMTEDTSTDTAYMELSSLRSEDTAVYYCATNSVGYWWKDFQHWGQGTLVTVSS |
| rHC + LC-G9 | SEQ ID NO: 1859 | EVQLVQSGAEVKKPGASVKVSCKVSGYTLSELSVHWVRQAPGKGLEWMGGFDPEYGETIYAQKFQGRVTMTEDTSTDTAYMELSSLRSEDTAVYYCATDTDGYWEKYFQHWGQGTLVTVSS |
| rHC + LC-H11 | SEQ ID NO: 1860 | EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDSEGYWEKFFQHWGQGTLVTVSS |

TABLE 6-continued

VH sequences of affinity matured AE10-6 variants

| Clone | SEQ ID NO: | VH |
|---|---|---|
| rHC + LC-H12 | SEQ ID NO: 1861 | EVQLVQSGAEVKKPGASVKVSCKVSGYTLSELSVHWVRQAPGKGLEWMGGFDPEAGEIIYAQKFQGRVTMTEDTSTDTAYMELSSLRSEDTAVYYCATDSAGYWYKYFQHWGQGTLVTVSS |
| rHC + LC-H2 | SEQ ID NO: 1862 | EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSDGFWEKFFQHWGQGTLVTVSS |
| rHC + LC-H3 | SEQ ID NO: 1863 | EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGFWEKFFQHWGQGTLVTVSS |
| rHC + LC-H6 | SEQ ID NO: 1864 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDAGGYWYKFFQHWGQGTLVTVSS |
| rHC + LC-H7 | SEQ ID NO: 1865 | EVQLVQSGAEVKKPGASVKVSCKVSGYTLSELSVHWVRQAPGKGLEWMGGFDPEDGETIYAQKFQGRVTMTEDTSTDTAYMELSSLRSEDTAVYYCATDTDGYWEKFFQHWGQGTLVTVSS |
| rHC + LC-H8 | SEQ ID NO: 1866 | EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDAAGYWYKFFQHWGQGTLVTVSS |

TABLE 7

VL sequences of affinity matured AE10-6 variants

| Clone | SEQ ID NO: | VL |
|---|---|---|
| LC-10 | SEQ ID NO: 1867 | QAVVTQEPSLTVSPGGTVTLTCGSSTGAVTIDHYPYWFQQKPGQAPRTLISDTDDKHSWTPARFSGSLLGGKAALTLSGAQPEDEAEYYCLLFDGGTLVFGGGTKLTVL |
| LC-31 | SEQ ID NO: 1868 | QAVVTQEPSLTVSPGGTVTLTCGLSTGNVTIWHYPYWFQQKPGQAPRTLIFDTNDKHSWTPARFSGSLLGGKAALTLSGAQPEDEAEYYCLLFYGGTVVFGGGTKLTVL |
| LC-45 | SEQ ID NO: 1869 | QAVVTQEPSLTVSPGGTVTLTCGSSTGNVTIWHYPYWFQQKPGQAPRTLISDTNDKHSWTPARFSGSLLGGKAALTLSGAQPEDEAEYYCLLFYGGTVVFGGGTKLTVL |
| LC-50 | SEQ ID NO: 1870 | QAVVTQEPSLTVSPGGTVTLTCGSSTGDVTIDHYPYWFQQKPGQAPRTLISDTDDKHSWTPARFSGSLLGGKAALTLSGAQPEDEAEYYCLLFYGGTLVFGGGTKLTVL |
| LC-67 | SEQ ID NO: 1871 | QAVVTQEPSLTVSPGGTVTLTCGSSTGAVTIDHYPYWFQQKPGQAPRTLISDTDDKHSWTPARFSGSLLGGKAALTLSGAQPEDEAEYYCLLFYGGTVVFGGGTKLTVL |
| LC-69 | SEQ ID NO: 1872 | QAVVTQEPSLTVSPGGTVTLTCGSSTGDVTIDHYPYWFQQKPGQAPRTLISDTNDKHSWTPARFSGSLLGGKAALTLSGAQPEDEAEYYCLLFYGGTLVFGGGTKLTVL |
| LC-88 | SEQ ID NO: 1873 | QAVVTQEPSLTVSPGGTVTLTCGSSTGPVTIDHYPYWFQQKPGQAPRTLISDTDDKHSWTPARFSGSLLGGKAALTLSGAQPEDEAEYYCLLFYGGTVVFGGGTKLTVL |
| LC-S10 | SEQ ID NO: 1874 | QAVVTQEPSLTVSPGGTVTLTCGSSTGNVTSGHYPYWFQQKPGQAPRTLISDTIDKHSWTPARFSGSLLGGKAALTLSGAQPEDEAEYYCLLFYGGTLVFGGGTKLTVL |
| LC-S12 | SEQ ID NO: 1875 | QAVVTQEPSLTVSPGGTVTLTCGSSTGGVTSEHYPYWFQQKPGQAPRTLISDTIDKHSWTPARFSGSLLGGKAALTLSGAQPEDEAEYYCLLFYGGTLVFGGGTKLTVL |
| LC-S13 | SEQ ID NO: 1876 | QAVVTQEPSLTVSPGGTVTLTCGSSTGAVTVNHYPYWFQQKPGQAPRTLISDTDDKHSWTPARFSGSLLGGKAALTLSGAQPEDEAEYYCLLFYGGTVVFGGGTKLTVL |

TABLE 7-continued

VL sequences of affinity matured AE10-6 variants

| Clone | SEQ ID NO: | VL |
|---|---|---|
| LC-S15 | SEQ ID NO: 1877 | QAVVTQEPSLTVSPGGTVTLTCGSSTGNVTIEHYPYWFQQKPGQAPRTLISDTNDKHSWTPARFSGSLLGGKAALTLSGAQPEDEAEYYCLLFYGGTMVFGGGTKLTVL |
| LC-S17 | SEQ ID NO: 1878 | QAVVTQEPSLTVSPGGTVTLTCGSSTGAVTIDHYPYWFQQKPGQAPRTLISDTNDKHSWTPARFSGSLLGGKAALTLSGAQPEDEAEYYCLLFNGGTLVFGGGTKLTVL |
| LC-S18 | SEQ ID NO: 1879 | QAVVTQEPSLTVSPGGTVTLTCGSSTGAVTIEHYPYWFQQKPGQAPRTLISDTNDKHSWTPARFSGSLLGGKAALTLSGAQPEDEAEYYCLLFYGGTVVFGGGTKLTVL |
| LC-S2 | SEQ ID NO: 1880 | QAVVTQEPSLTVSPGGTVTLTCGSSTGSVTSDHYPYWFQQKPGQAPRTLISDTNDKHSWTPARFSGSLLGGKAALTLSGAQPEDEAEYYCLLFYGGTLVFGGGTKLTVL |
| LC-S20 | SEQ ID NO: 1881 | QAVVTQEPSLTVSPGGTVTLTCGSSTGEVTIDHYPYWFQQKPGQAPRTLISDTNDKHSWTPARFSGSLLGGKAALTLSGAQPEDEAEYYCLLFYGGSVVFGGGTKLTVL |
| LC-S21 | SEQ ID NO: 1882 | QAVVTQEPSLTVSPGGTVTLTCGSSTGSVTIDHYPYWFQQKPGQAPRTLISDTNDKHSWTPARFSGSLLGGKAALTLSGAQPEDEAEYYCLLFYGGTVVFGGGTKLTVL |
| LC-S22 | SEQ ID NO: 1883 | QAVVTQEPSLTVSPGGTVTLTCGSSTGPVTSDHYPYWFQQKPGQAPRTLISDTIDKHSWTPARFSGSLLGGKAALTLSGAQPEDEAEYYCLLFYGGTVVFGGGTKLTVL |
| LC-S23 | SEQ ID NO: 1884 | QAVVTQEPSLTVSPGGTVTLTCGSSTGAVTIGHYPYWFQQKPGQAPRTLISDTDDKHSWTPARFSGSLLGGKAALTLSGAQPEDEAEYYCLLFYGGTLVFGGGTKLTVL |
| LC-S24 | SEQ ID NO: 1885 | QAVVTQEPSLTVSPGGTVTLTCGSSTGAVTSEHYPYWFQQKPGQAPRTLISDTNDKHSWTPARFSGSLLGGKAALTLSGAQPEDEAEYYCLLFYGGNLVFGGGTKLTVL |
| LC-S26 | SEQ ID NO: 1886 | QAVVTQEPSLTVSPGGTVTLTCGSSTGAVTIEHYPYWFQQKPGQAPRTLISDTDDKHSWTPARFSGSLLGGKAALTLSGAQPEDEAEYYCLLFYGGTVVFGGGTKLTVL |
| LC-S27 | SEQ ID NO: 1887 | QAVVTQEPSLTVSPGGTVTLTCGSSTGAVTSDHYPYWFQQKPGQAPRTLISDTNDKHSWTPARFSGSLLGGKAALTLSGAQPEDEAEYYCLLFYGGTLVFGGGTKLTVL |
| LC-S28 | SEQ ID NO: 1888 | QAVVTQEPSLTVSPGGTVTLTCGSSTGDVTIYHYPYWFQQKPGQAPRTFISDTRDKHSWTPARFSGSLLGGKAALTLSGAQPEDEAEYYCLLFYGGTVVFGGGTKLTVL |
| LC-S29 | SEQ ID NO: 1889 | QAVVTQEPSLTVSPGGTVTLTCGSSTGAVTSEHYPYWFQQKPGQAPRTLISDTDDKHSWTPARFSGSLLGGKAALTLSGAQPEDEAEYYCLLFYGGTLVFGGGTKLTVL |
| LC-S30 | SEQ ID NO: 1890 | QAVVTQEPSLTVSPGGTVTLTCGSSTGAVTSEHYPYWFQQKPGQAPRTLISDTNDKHSWTPARFSGSLLGGKAALTLSGAQPEDEAEYYCLLFYGGTLVFGGGTKLTVL |
| LC-S31 | SEQ ID NO: 1891 | QAVVTQEPSLTVSPGGTVTLTCGSSTGAVTSGHYPYWFQQKPGQAPRTLISDTDDKHSWTPARFSGSLLGGKAALTLSGAQPEDEAEYYCLLDYGGTFVFGGGTKLTVL |
| LC-S32 | SEQ ID NO: 1892 | QAVVTQEPSLTVSPGGTVTLTCGSSTGGVTIDHYPYWFQQKPGQAPRTLISDTNDKHSWTPARFSGSLLGGKAALTLSGAQPEDEAEYYCLLFYGGTLVFGGGTKLTVL |
| LC-S33 | SEQ ID NO: 1893 | QAVVTQEPSLTVSPGGTVTLTCGSSTGAVTIEHYPYWFQQKPGQAPRTLISDTDDKHSWTPARFSGSLLGGKAALTLSGAQPEDEAEYYCLLFYGGNVVFGGGTKLTVL |
| LC-S35 | SEQ ID NO: 1894 | QAVVTQEPSLTVSPGGTVTLTCGSSTGPVTIDHYPYWFQQKPGQAPRTLISDTNDKHSWTPARFSGSLLGGKAALTLSGAQPEDEAEYYCLLFYGGTLVFGGGTKLTVL |
| LC-S36 | SEQ ID NO: 1895 | QAVVTQEPSLTVSPGGTVTLTCGSSTGEVTIDHYPYWFQQKPGQAPRTLISDTNDKHSWTPARFSGSLLGGKAALTLSGAQPEDEAEYYCLLFYGGTVVFGGGTKLTVL |

TABLE 7-continued

VL sequences of affinity matured AE10-6 variants

| Clone | SEQ ID NO: | VL |
|---|---|---|
| LC-S37 | SEQ ID NO: 1896 | QAVVTQEPSLTVSPGGTVTLTCGSSTGAVTIEHYPYW FQQKPGQAPRTLISDTNDKHSWTPARFSGSLLGGKA ALTLSGAQPEDEAEYYCLLFYGGTLVFGGGTKLTVL |
| LC-S38 | SEQ ID NO: 1897 | QAVVTQEPSLTVSPGGTVTLTCGSSTGDVTIEHYPYW FQQKPGQAPRTLVSDTNDKHSWTPARFSGSLLGGKA ALTLSGAQPEDEAEYYCLLFFGGTMVFGGGTKLTVL |
| LC-S39 | SEQ ID NO: 1898 | QAVVTQEPSLTVSPGGTVTLTCGSSTGDVTIDHYPYW FQQKPGQAPRTLISDTNDKHSWTPARFSGSLLGGKA ALTLSGAQPEDEAEYYCLLDYGGSVVFGGGTKLTVL |
| LC-S40 | SEQ ID NO: 1899 | QAVVTQEPSLTVSPGGTVTLTCGSSTGAVTIEHYPYW FQQKPGQAPRTLISDTIDKHSWTPARFSGSLLGGKA ALTLSGAQPEDEAEYYCLLFYGGTVVFGGGTKLTVL |
| LC-S41 | SEQ ID NO: 1900 | QAVVTQEPSLTVSPGGTVTLTCGSSTGDVTSGHYPYW FQQKPGQAPRTLISDTDDKHSWTPARFSGSLLGGKA ALTLSGAQPEDEAEYYCLLFYGGTLVFGGGTKLTVL |
| LC-S42 | SEQ ID NO: 1901 | QAVVTQEPSLTVSPGGTVTLTCGSSTGSVTSGHYTYW FQQKPGQAPRTLISDTDDKHSWTPARFSGSLLGGKA ALTLSGAQPEDEAEYYCLLFYGGRLVFGGGTKLTVL |
| LC-S44 | SEQ ID NO: 1902 | QAVVTQEPSLTVSPGGTVTLTCGSSTGPVTSEHYPYW FQQKPGQAPRTLISDTDDKHSWTPARFSGSLLGGKA ALTLSGAQPEDEAEYYCLLFYGGTVVFGGGTNLTVL |
| LC-S45 | SEQ ID NO: 1903 | QAVVTQEPSLTVSPGGTVTLTCGSSTGAVTTEHYPYW FQQKPGQAPRTLISDTIDKHSWTPARFSGSLLGGKA ALTLSGAQPEDEAEYYCLLFYGGTLVFGGGTKLTVL |
| LC-S46 | SEQ ID NO: 1904 | QAVVTQEPSLTVSPGGTVTLTCGSSTGEVTIGHYPYW FQQKPGQAPRTLISDTNDKHSWTPARFSGSLLGGKA ALTLSGAQPEDEAEYYCLLFYGGTLVFGGGTKLTVL |
| LC-S49 | SEQ ID NO: 1905 | QAVVTQEPSLTVSPGGTVTLTCGSSTGSVTSEHYPYW FQQKPGQAPRTLISDTNDKHSWTPARFSGSLLGGKA ALTLSGAQPEDEAEYYCLLFYGGTLVFGGGTKLTVL |
| LC-S50 | SEQ ID NO: 1906 | QAVVTQEPSLTVSPGGTVTLTCGSSTGAVTSDHYPYW FQQKPGQAPRTLISDTDDKHSWTPARFSGSLLGGKA ALTLSGAQPEDEAEYYCLLFYGGTLVFGGGTKLTVL |
| LC-S51 | SEQ ID NO: 1907 | QAVVTQEPSLTVSPGGTVTLTCGSSTGAVTSEHYPYW FQQKPGQAPRTLISDTDDKHSWTPARFSGSLLGGKA ALTLSGAQPEDEAEYYCLLFYGGNLVFGGGTKLTVL |
| LC-S52 | SEQ ID NO: 1908 | QAVVTQEPSLTVSPGGTVTLTCGSSTGEVTGDHYPYW FQQKPGQAPRTLISDTNDKHSWTPARFSGSLLGGKA ALTLSGAQPEDEAEYYCLLFYGGTLVFGGGTKLTVL |
| LC-S54 | SEQ ID NO: 1909 | QAVVTQEPSLTVSPGGTVTLTCGSSTGAVTSDHYPYW FQQKPGQAPRTLISDTIDKHSWTPARFSGSLLGGKA ALTLSGAQPEDEAEYYCLLFYGGTLVFGGGTKLTVL |
| LC-S57 | SEQ ID NO: 1910 | QAVVTQEPSLTVSPGGTVTLTCGSSTGGVTIDHYPYW FQQKPGQAPRTLISDTNDKHSWTPARFSGSLLGGKA ALTLSGAQPEDEAEYYCLLFYGGSLVFGGGTKLTVL |
| LC-S58 | SEQ ID NO: 1911 | QAVVTQEPSLTVSPGGTVTLTCGSSTGPVTSEHYPYW FQQKPGQAPRTLISDTNDKHSWTPARFSGSLLGGKA ALTLSGAQPEDEAEYYCLLFYGGTLVFGGGTKLTVL |
| LC-S6 | SEQ ID NO: 1912 | QAVVTQEPSLTVSPGGTVTLTCGSSTGPVTSEHYPYW FQQKPGQAPRTLISDTDDKHSWTPARFSGSLLGGKA ALTLSGAQPEDEAEYYCLLFYGGTMVFGGGTKLTVL |
| LC-S60 | SEQ ID NO: 1913 | QAVVTQEPSLTVSPGGTVTLTCGSSTGPVTSEHYPYW FQQKPGQAPRTLISDTDDKHSWTPARFSGSLLGGKA ALTLSGAQPEDEAEYYCLLFYGGTVVFGGGTKLTVL |
| LC-S61 | SEQ ID NO: 1914 | QAVVTQEPSLTVSPGGTVTLTCGSSTGGVTSEHYPYW FQQKPGQAPRTLIYDTIEKDSWTPARFSGSLLGGKA ALTLSGAQPEDEAEYYCLLFYGGTLVFGGGTKLTVL |

TABLE 7-continued

VL sequences of affinity matured AE10-6 variants

| Clone | SEQ ID NO: | VL |
|---|---|---|
| LC-S64 | SEQ ID NO: 1915 | QAVVTQEPSLTVSPGGTVTLTCGSSTGAVTSGHYPYW FQQKPGQAPRTLISDTNDKHSWTPARFSGSLLGGKA ALTLSGAQPEDEAEYYCLLFYGGTVVFGGGTKLTVL |
| LC-S66 | SEQ ID NO: 1916 | QAVVTQEPSLTVSPGGTVTLTCGSSTGAVTSEHYPYW FQQKPGQAPRTLISDTDDKHSWTPARFSGSLLGGKA ALTLSGAQPEDEAEYYCLLFYGGTVVFGGGTKLTVL |
| LC-S7 | SEQ ID NO: 1917 | QAVVTQEPSLTVSPGGTVTLTCGSSTGDVTIDHYPYW FQQKPGQAPRTLISDTNDKHSWTPARFSGSLLGGKA ALTLSGAQPEDEAEYYCLLFYGGTVVFGGGTKLTVL |
| LC-S70 | SEQ ID NO: 1918 | QAVVTQEPSLTVSPGGTVTLTCGSSTGAVTIEHYPYW FQQKPGQAPRTLISDTNDKHSWTPARFSGSLLGGKA ALTLSGAQPEDEAEYYCLLFYGGNVVFGGGTKLTVL |
| LC-S74 | SEQ ID NO: 1919 | QAVVTQEPSLTVSPGGTVTLTCGSSTGDVTIDHYPYW FQQKPGQAPRTLISDTDDKQSWTPARFSGSLLGGKA ALTLSGAQPEDEAEYYCLLFYGGTVVFGGGTKLTVL |
| LC-S75 | SEQ ID NO: 1920 | QAVVTQEPSLTVSPGGTVTLTCGSSTGPVTIDHYPYW FQQKPGQAPRTLISDTNDKHSWTPARFSGSLLGGKA ALTLSGAQPEDEAEYYCLLFYGGTVVFGGGTKLTVL |
| LC-S76 | SEQ ID NO: 1921 | QAVVTQEPSLTVSPGGTVTLTCGSSTGAVTIEHYPYW FQQKPGQAPRTLISDTNDKHSWTPARFSGSLLGGKA ALTLSGAQPEDEAEYYCLLFFGGTVVFGGGTKLTVL |
| LC-S8 | SEQ ID NO: 1922 | QAVVTQEPSLTVSPGGTVTLTCGSSTGAVTIWHYPYW FQQKPGQAPRTLISDTNDKHSWTPARFSGSLLGGKA ALTLSGAQPEDEAEYYCLLDDGSTVVFGGGTKLTVL |
| LC-S80 | SEQ ID NO: 1923 | QAVVTQEPSLTVSPGGTVTLTCGSSTGAVTSGHYPYW FQQKPGQAPRTLIYDTDDKNSWTPARFSGSLLGGKA ALTLSGAQPEDEAEYYCLLDYGGTFVFGGGTKLTVL |
| LC-S82 | SEQ ID NO: 1924 | QAVVTQEPSLTVSPGGTVTLTCGSSTGAVTIWHYPYW FQQKPGQAPRTLISDTNDKHSWTPARFSGSLLGGKA ALTLSGAQPEDEAEYYCLLFDGGTVVFGGGTKLTVL |
| LC-S83 | SEQ ID NO: 1925 | QAVVTQEPSLTVSPGGTVTLTCGSSTGGVTSGHYPYW FQQKPGQAPRTLISDTNDKHSWTPARFSGSLLGGKA ALTLSGAQPEDEAEYYCLLFYGGTVVFGGGTKLTVL |
| LC-S85 | SEQ ID NO: 1926 | QAVVTQEPSLTVSPGGTVTLTCGSSTGDVTSEHYPYW FQQKPGQAPRTLISDTDDKHSWTPARFSGSLLGGKA ALTLSGAQPEDEAEYYCLLFYGGTLVFGGGTKLTVL |
| LC-S86 | SEQ ID NO: 1927 | QAVVTQEPSLTVSPGGTVTLTCGSSTGNVTSEHYPYW FQQKPGQAPRTLISDTNDKHSWTPARFSGSLLGGKA ALTLSGAQPEDEAEYYCLLFYGGTLVFGGGTKLTVL |
| LC-S88 | SEQ ID NO: 1928 | QAVVTQEPSLTVSPGGTVTLTCGSSTGDVTIGHYPYW FQQKPGQAPRTLISDTNDKHSWTPARFSGSLLGGKA ALTLSGAQPEDEAEYYCLLFYGGTMVFGGGTKLTVL |
| LC-S89 | SEQ ID NO: 1929 | QAVVTQEPSLTVSPGGTVTLTCGSSTGGVTSEHYPYW FQQKPGQAPRTLISDTDDKHSWTPARFSGSLLGGKA ALTLSGAQPEDEAEYYCLLFDGGTLVFGGGTKLTVL |
| LC-S9 | SEQ ID NO: 1930 | QAVVTQEPSLTVSPGGTVTLTCGSSTGAVTIDHYPYW FQQKPGQAPRTLISDTNDKHSWTPARFSGSLLGGKA ALTLSGAQPEDEAEYYCLLFYGGTLVFGGGTKLTVL |
| LC-S90 | SEQ ID NO: 1931 | QAVVTQEPSLTVSPGGTVTLTCGSSTGPVTIEHYPYW FQQKPGQAPRTLISDTNDKHSWTPARFSGSLLGGKA ALTLSGAQPEDEAEYYCLLFYGGTVVFGGGTKLTVL |
| LC-S91 | SEQ ID NO: 1932 | QAVVTQEPSLTVSPGGTVTLTCGSSTGNVTSEHYPYW FQQKPGQAPRTLISDTNDKHSWTPARFSGSLLGGKA ALTLSGAQPEDEAEYYCLLFYGGTVVFGGGTKLTVL |
| LC-S92 | SEQ ID NO: 1933 | QAVVTQEPSLTVSPGGTVTLTCGSSTGAVTIEHYPYW FQQKPGQAPRTLISDTNDKHSWTPARFSGSLLGGKA ALTLSGAQPEDEAEYYCLLFYGGSMVFGGGTKLTVL |

TABLE 7-continued

VL sequences of affinity matured AE10-6 variants

| Clone | SEQ ID NO: | VL |
|---|---|---|
| LC-S93 | SEQ ID NO: 1934 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLFDRGSMVFGGGTKLTVL |
| LC-S94 | SEQ ID NO: 1935 | QAVVTQEPSLTVSPGGTVTLTCGSSTGTVTSEHYPYW FQQKPGQAPRTLISDTDDKHSWTPARFSGSLLGGKA ALTLSGAQPEDEAEYYCLLFYGGTLVFGGGTKLTVL |
| LC-S95 | SEQ ID NO: 1936 | QAVVTQEPSLTVSPGGTVTLTCGSSTGAVTIDHYPYW FQQKPGQAPRTLISDTNDKHSWTPARFSGSLLGGKA ALTLSGAQPEDEAEYYCLLFYGGTVVFGGGTKLTVL |
| rHC + LC-1 | SEQ ID NO: 1937 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLDYGGTFVFGGGTKLTVL |
| rHC + LC-100 | SEQ ID NO: 1938 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLDYEGTFVFGGGTKLTVL |
| rHC + LC-109 | SEQ ID NO: 1939 | QAVVTQEPSLTVSPGGTVTLTCGSSTGGVTIDHYPYW FQQKPGQAPRTLISDTDDKHSWTPARFSGSLLGGKA ALTLSGAQPEDEAEYYCLLDYGGSFVFGGGTKLTVL |
| rHC + LC-113 | SEQ ID NO: 1940 | QAVVTQEPSLTVSPGGTVTLTCGSSTGPVTIEHYPYW FQQKPGQAPRTLISDTDDKHSWTPARFSGSLLGGKA ALTLSGAQPEDEAEYYCLLFYGGTVVFGGGTKLTVL |
| rHC + LC-143 | SEQ ID NO: 1941 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLFYGGTVVFGGGTKLTVL |
| rHC + LC-149 | SEQ ID NO: 1942 | QAVVTQEPSLTVSPGGTVTLTCGSSTGAVTIWHYPYW FQQKPGQAPRTLISDTXDKHSWTPARFSGSLLGGKA ALTLSGAQPEDEAEYYCLLDYGGSFVFGGGTKLTVL |
| rHC + LC-175 | SEQ ID NO: 1943 | QAVVTQEPSLTVSPGGTVTLTCGSSTGNVTIEHYPYW FQQKPGQAPRTLISDTDDKHSWTPARFSGSLLGGKA ALTLSGAQPEDEAEYYCLLDYRGTFVFGGGTKLTVL |
| rHC + LC-26 | SEQ ID NO: 1944 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLDYRGTFVFGGGTKLTVL |
| rHC + LC-43 | SEQ ID NO: 1945 | QAVVTQEPSLTVSPGGTVTLTCGSSTGSVTIDHYPYW FQQKPGQAPRTLISDTDDKHSWTPARFSGSLLGGKA ALTLSGAQPEDEAEYYCLLDYGGSFVFGGGTKLTVL |
| rHC + LC-5 | SEQ ID NO: 1946 | QAVVTQEPSLTVSPGGTVTLTCGSSTGPVTIDHYPYW FQQKPGQAPRTLISDTDDKHSWTPARFSGSLLGGKA ALTLSGAQPEDEAEYYCLLDYGGSFVFGGGTKLTVL |
| rHC + LC-60 | SEQ ID NO: 1947 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLDFGGTFVFGGGTKLTVL |
| rHC + LC-66 | SEQ ID NO: 1948 | QAVVTQEPSLTVSPGGTVTLTCGSSTGTVTIDHYPYW FQQKPGQAPRTLISDTDDKHSWTPARFSGSLLGGKA ALTLSGAQPEDEAEYYCLLDYGGRFVFGGGTKLTVL |
| rHC + LC-69 | SEQ ID NO: 1949 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLDYGGSFVFGGGTKLTVL |
| rHC + LC-75 | SEQ ID NO: 1950 | QAVVTQEPSLTVSPGGTVTLTCGSSTGAVTIWHYPYW FQQKPGQAPRTLISDTNDKHSWTPARFSGSLLGGKA ALTLSGAQPEDEAEYYCLLDYGGSFVFGGGTKLTVL |
| rHC + LC-83 | SEQ ID NO: 1951 | QAVVTQEPSLTVSPGGTVTLTCGSSTGAVTIDHYPYW FQQKPGQAPRTLISDTIYKESWTPARFAGSLLGGKA ALTLSGAQPEDEAEYYCLLDYGGTFVFGGGTKLTVL |
| rHC + LC-93 | SEQ ID NO: 1952 | QAVVTQEPSLTVSQGGTVTLTCGSSTGDVTIDHYPYW FQQKPGQAPRTLISDTDDKHSWTPARFSGSLLGGKA ALTLSGAQPEDEAEYYCLLDYRGNMVFGGGTKLTVL |

TABLE 7-continued

VL sequences of affinity matured AE10-6 variants

| Clone | SEQ ID NO: | VL |
|---|---|---|
| rHC + LC-94 | SEQ ID NO: 1953 | QAVVTQEPSLTVSPGGTVTLTCGSSTGDVTIDHYPYW FQQKPGQAPRTLISDTDDKHSWTPARFSGSLLGGKA ALTLSGAQPEDEAEYYCLLDYGGTFVFGGGTKLTVL |
| rHC + LC-99 | SEQ ID NO: 1954 | QAVVTQEPSLTVSPGGTVTLTCGSSTGPVTIDHYPYW FQQKPGQAPRTLISDTIDKHSWTPARFSGSLLGGKA ALTLSGAQPEDEAEYYCLLDYGGAFVFGGGTKLTVL |
| rHC + LC-A10 | SEQ ID NO: 1955 | QAVVTQEPSLTVSPGGTVTLTCGSSTGAVTIDHYPYW FQQKPGQAPRTLISDTNDKHSWTPARFSGSLLGGKA ALTLSGAQPEDEAEYYCLLFYGGRLVFGGGTKLTVL |
| rHC + LC-A12 | SEQ ID NO: 1956 | QAVVTQEPSLTVSPGGTVTLTCGSSTGAVTIDHYPYW FQQKPGQAPRTLISDTIDKHSWTPARFSGSLLGGKA ALTLSGAQPEDEAEYYCLLFYGGTVVFGGGTKLTVL |
| rHC + LC-A2 | SEQ ID NO: 1957 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLDYDGTFVFGGGTKLTVL |
| rHC + LC-A3 | SEQ ID NO: 1958 | QAVVTQEPSLTVSPGGTVTLTCGSSTGEVTSEHYPYW FQQKPGQAPRTLISDTIDKHSWTPARFSGSLLGGKA ALTLSGAQPEDEAEYYCLLFYGGTLVFGGGTKLTVL |
| rHC + LC-A8 | SEQ ID NO: 1959 | QAVVTQEPSLTVSPGGTVTLTCGSSTGDVTIDHYPYW FQQKPGQAPRTLISDTDDKHSWTPARFSGSLLGGKA ALTLSGAQPEDEAEYYCLLDYRGTMVFGGGTKLTVL |
| rHC + LC-B1 | SEQ ID NO: 1960 | QAVVTQEPSLTVSPGGTVTLTCGSSTGTVTIDHYPYW FQQKPGQAPRTLISDTDDKHSWTPARFSGSLLGGKA ALTLSGAQPEDEAEYYCLLFYGGTVVFGGGTKLTVL |
| rHC + LC-B12 | SEQ ID NO: 1961 | QAVVTQEPSLTVSPGGTVTLTCGSSTGAVTIDHYPYW FQQKPGQAPRTLISDTNDKHSWTPARFSGSLLGGKA ALTLSGAQPEDEAEYYCLLDYNGTFVFGGGTKLTVL |
| rHC + LC-B4 | SEQ ID NO: 1962 | QAVVTQEPSLTVSPGGTVTLTCGSSTGDVTIDHYPYW FQQKPGQAPRTLISDTDDKHSWTPARFSGSLLGGKA ALTLSGAQPEDEAEYYCLLDYGGRFVFGGGTKLTVL |
| rHC + LC-C1 | SEQ ID NO: 1963 | QAVVTQEPSLTVSPGGTVTLTCGSSTGNVTMWHYPYW FQQKPGQAPRTLISDTDDKHSWTPARFSGSLLGGKA ALTLSGAQPEDEAEYYCLLDYGGRFVFGGGTKLTVL |
| rHC + LC-C11 | SEQ ID NO: 1964 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLFYGGNLVFGGGTKLTVL |
| rHC + LC-C12 | SEQ ID NO: 1965 | QAVVTQEPSLTVSPGGTVTLTCGSSTGAVTIDHYPYW FQQKPGQAPRTLISDTNDKHSWTPARFSGSLLGGKA ALTLSGAQPEDEAEYYCLLDYGGAFVFGGGTKLTVL |
| rHC + LC-C2 | SEQ ID NO: 1966 | QAVVTQEPSLTVSPGGTVTLTCGSSTGAVTIDHYPYW FQQKPGQAPRTLISDTNDKHSWTPARFSGSLLGGKA ALTLSGAQPEDEAEYYCLLDFGGTFVFGGGTKLTVL |
| rHC + LC-C3 | SEQ ID NO: 1967 | QAVVTQEPSLTVSPGGTVTLTCGSSTGAVTIDHYPYW FQQKPGQAPRTLISDTNDKHSWTPARFSGSLLGGKA ALTLSGAQPEDEAEYYCLLDYGGTFVFGGGTKLTVL |
| rHC + LC-C4 | SEQ ID NO: 1968 | QAVVTQEPSLTVSPGGTVTLTCGSSTGPVTIDHYPYW FQQKPGQAPRTLISDTNDKHSWTPARFSGSLLGGKA ALTLSGAQPEDEAEYYCLLDYGGRFVFGGGTKLTVL |
| rHC + LC-C6 | SEQ ID NO: 1969 | QAVVTQEPSLTVSPGGTVTLTCGSSTGAVTIDHYPYW FQQKPGQAPRTLISDTNDKHSWTPARFSGSLLGGKA ALTLSGAQPEDEAEYYCLLFNGGNVVFGGGTKLTVL |
| rHC + LC-C7 | SEQ ID NO: 1970 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLFFGGTVVFGGGTKLTVL |
| rHC + LC-C8 | SEQ ID NO: 1971 | QAVVTQEPSLTVSPGGTVTLTCGSSTGRVTIDHYPYW FQQKPGQAPRTLISDTNDKHSWTPARFSGSLLGGKA ALTLSGAQPEDEAEYYCLLDFGGTFVFGGGTKLTVL |

TABLE 7-continued

VL sequences of affinity matured AE10-6 variants

| Clone | SEQ ID NO: | VL |
|---|---|---|
| rHC + LC-D10 | SEQ ID NO: 1972 | QAVVTQEPSLTVSPGGTVTLTCGSSTGSVTIDHYPYW<br>FQQKPGQAPRTLISDTDDKHSWTPARFSGSLLGGKA<br>ALTLSGAQPEDEAEYYCLLDYEGTFVFGGGTKLTVL |
| rHC + LC-D11 | SEQ ID NO: 1973 | QAVVTQEPSLTVSPGGTVTLTCGSSTGAVTIDHYPYW<br>FQQKPGQAPRTLISDTNDKHSWTPARFSGSLLGGKA<br>ALTLSGAQPEDEAEYYCLLFYGGTVVFGGGTKLTVL |
| rHC + LC-D3 | SEQ ID NO: 1974 | QAVVTQEPSLTVSPGGTVTLTCGSSTGDVTIDHYPYW<br>FQQKPGQAPRTLISDTDDKHSWTPARFSGSLLGGKA<br>ALTLSGAQPEDEAEYYCLLFYGGTVVFGGGTKLTVL |
| rHC + LC-D6 | SEQ ID NO: 1975 | QAVVTQEPSLTVSPGGTVTLTCGSSTGNVTIEHYPYW<br>FQQKPGQAPRTLISDTDDKHSWTPARFSGSLLGGKA<br>ALTLSGAQPEDEAEYYCLLFYGGTLVFGGGTKLTVL |
| rHC + LC-E11 | SEQ ID NO: 1976 | QAVVTQEPSLTVSPGGTVTLTCGSSTGNVTVDHYPYW<br>FQQKPGQAPRTLISDTTDKHSWTPARFSGSLLGGKA<br>ALTLSGAQPEDEAEYYCLLDYGGTFVFGGGTKLTVL |
| rHC + LC-E3 | SEQ ID NO: 1977 | QAVVTQEPSLTVSPGGTVTLTCGSSTGDVTTDHYPYW<br>FQQKPGQAPRTLISDTNDKHSWTPARFSGSLLGGKA<br>ALTLSGAQPEDEAEYYCLLFYGGTLVFGGGTKLTVL |
| rHC + LC-E5 | SEQ ID NO: 1978 | QAVVTQEPSLTVSPGGTVTLTCGSSTGNVTIDHYPYW<br>FQQKPGQAPRTLISDTDDKHSWTPARFSGSLLGGKA<br>ALTLSGAQPEDEAEYYCLLDYGGTFVFGGGTKLTVL |
| rHC + LC-E6 | SEQ ID NO: 1979 | QAVVTQEPSLTVSPGGTVTLTCGSSTGAVTIDHYPYW<br>FQQKPGQAPRTLISDTNDKHSWTPARFSGSLLGGKA<br>ALTLSGAQPEDEAEYYCLLDYGGTLVFGGGTKLTVL |
| rHC + LC-E8 | SEQ ID NO: 1980 | QAVVTQEPSLTVSPGGTVTLTCGSSTGAVTIDHYPYW<br>FQQKPGQAPRTLISDTNDKHSWTPARFSGSLLGGKA<br>ALTLSGAQPEDEAEYYCLLDDGGTFVFGGGTKLTVL |
| rHC + LC-E9 | SEQ ID NO: 1981 | QAVVTQEPSLTVSPGGTVTLTCGSSTGAVTIEHYPYW<br>FQQKPGQAPRTLISDTNDKHSWTPARFSGSLLGGKA<br>ALTLSGAQPEDEAEYYCLLDYGGTFVFGGGTKLTVL |
| rHC + LC-F10 | SEQ ID NO: 1982 | QAVVTQEPSLTVSPGGTVTLTCGSSTGAVTIDHYPYW<br>FQQKPGQAPRTLIFDTIDKHSWTPARFSGSLLGGKA<br>ALTLSGAQPEDEAEYYCLLFYGGTVVFGGGTKLTVL |
| rHC + LC-F12 | SEQ ID NO: 1983 | QAVVTQEPSLTVSPGGTVTLTCGSSTGAVTIDHYPYW<br>FQQKPGQAPRTLISDTDDKHSWTPARFSGSLLGGKA<br>ALTLSGAQPEDEAEYYCLLDYGGTLVFGGGTKLTVL |
| rHC + LC-F3 | SEQ ID NO: 1984 | QAVVTQEPSLTVSPGGTVTLTCGSSTGSVTIDHYPYW<br>FQQKPGQAPRTLISDTIDKHSWTPARFSGSLLGGKA<br>ALTLSGAQPEDEAEYYCLLDYGGAFVFGGGTKLTVL |
| rHC + LC-F4 | SEQ ID NO: 1985 | QAVVTQEPSLTVSPGGTVTLTCGSSTGAVTIDHYPYW<br>FQQKPGQAPRTLISDTNDKHSWTPARFSGSLLGGKA<br>ALTLSGAQPEDEAEYYCLLDYEGTFVFGGGTKLTVL |
| rHC + LC-G1 | SEQ ID NO: 1986 | QAVVTQEPSLTVSPGGTVTLTCGSSTGAVTAGHYPYW<br>FQQKPGQAPRTLISDTIDKHSWTPARFSGSLLGGKA<br>ALTLSGAQPEDEAEYYCLLDYGGAFVFGGGTKLTVL |
| rHC + LC-G11 | SEQ ID NO: 1987 | QAVVTQEPSLTVSPGGTVTLTCGSSTGEVTIGHYPYW<br>FQQKPGQAPRTLISDTDDKHSWTPARFSGSLLGGKA<br>ALTLSGAQPEDEAEYYCLLDYRGTMVFGGGTKLTVL |
| rHC + LC-G12 | SEQ ID NO: 1988 | QAVVTQEPSLTVSPGGTVTLTCGSSTGEVTIDHYPYW<br>FQQKPGQAPRTLISDTNDKHSWTPARFSGSLLGGKA<br>ALTLSGAQPEDEAEYYCLLDYGGTFVFGGGTKLTVL |
| rHC + LC-G2 | SEQ ID NO: 1989 | QAVVTQEPSLTVSPGGTVTLTCGSSTGAVTSGHYPYW<br>FQQKPGQAPRTLISDTDDKHSWTPARFSGSLLGGKA<br>ALTLSGAQPEDEAEYYCLLDYGGTFVFGGGTKLTVL |
| rHC + LC-G6 | SEQ ID NO: 1990 | QAVVTQEPSLTVSPGGTVTLTCGSSTGAVTIEHYPYW<br>FQQKPGQAPRTLISDTNDKHSWTPARFSGSLLGGKA<br>ALTLSGAQPEDEAEYYCLLDFGGTFVFGGGTKLTVL |

TABLE 7-continued

VL sequences of affinity matured AE10-6 variants

| Clone | SEQ ID NO: | VL |
|---|---|---|
| rHC + LC-G7 | SEQ ID NO: 1991 | QAVVTQEPSLTVSPGGTVTLTCGSSTGDVTIGHYPYW FQQKPGQAPRTLISDTDDKHSWTPARFSGSLLGGKA ALTLSGAQPEDEAEYYCLLDYGGTFVFGGGTKLTVL |
| rHC + LC-H1 | SEQ ID NO: 1993 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLDYGGNFVFGGGTKLTVL |
| rHC + LC-H12 | SEQ ID NO: 1994 | QAVVTQEPSLTVSPGGTVTLTCGSSTGDVTIDHYPYW FQQKPGQAPRTLISDTDDKPSWTPARFSGSLLGGKA ALTLSGAQPEDEAEYYCLLDYGGTFVFGGGTKLTVL |
| rHC + LC-H3 | SEQ ID NO: 1995 | QAVVTQEPSLTVSPGGTVTLTCGSSTGAVTIDHYPYW FQQKPGQAPRTLISDTNDKHSWTPARFSGSLLGGKA ALTLSGAQPEDEAEYYCLLDYGGRFVFGGGTKLTVL |
| rHC + LC-H4 | SEQ ID NO: 1996 | QAVVTQEPSLTVSPGGTVTLTCGSSTGDVTIEHYPYW FQQKPGQAPRTLISDTDDKHSWTPARFSGSLLGGKA ALTLSGAQPEDEAEYYCLLFYGGNVVFGGGTKLTVL |
| rHC + LC-H6 | SEQ ID NO: 1997 | QAVVTQEPSLTVSPGGTVTLTCGSSTGAVTIDHYPYW FQQKPGQAPRTLISDTDDKHSWTPARFSGSLLGGKA ALTLSGAQPEDEAEYYCLLDYGGTVVFGGGTKLTVL |

The tables below provide a list of AE10-6 clones which were converted into IgG proteins for characterization, both VH (Table 8) and VL (Table 9) sequences.

TABLE 8

VH sequences of IgG converted clones

| Protein region | SEQ ID NO | Sequence 12345678901234567890123456789 0 |
|---|---|---|
| AM1 VH | SEQ ID NO: 1998 | EVQLVQSGAEVKKPGASVKVSCKVSGYTLSE LSMHWVRQAPGKGLEWMGGFDPEVGELIYAQ KFQGRVTMTEDTSTDTAYMELSSLRSEDTAV YYCATDTDGYWEKFFQHWGQGTLVTVSS |
| AM1 VH | CDR-H1 Residues 31-35 of SEQ ID NO.: 1998 | ELSMH |
| AM1 VH | CDR-H2 Residues 50-66 of SEQ ID NO.: 1998 | GFDPEVGELIYAQKFQG |
| AM1 VH | CDR-H3 Residues 99-110 of SEQ ID NO.: 1998 | DTDGYWEKFFQH |
| AM2 VH | SEQ ID NO: 1999 | EVQLVQSGAEVKKPGASVKVSCKVSGYTLTE LSMHWVRQAPGKGLEWMGGFDPEAGETIYAQ KFQGRVTMTEDTSTDTAYMELSSLRSEDTAV YYCATDGELYWYKFFQHWGQGTLVTVSS |
| AM2 VH | CDR-H1 Residues 31-35 of SEQ ID NO.: 1999 | ELSMH |
| AM2 VH | CDR-H2 Residues 50-66 of SEQ ID NO.: 1999 | GFDPEAGETIYAQKFQG |
| AM2 VH | CDR-H3 Residues 99-110 of SEQ ID NO.: 1999 | GFDPEAGETIYAQKFQG |
| AM3 VH | SEQ ID NO: 2000 | EVQLVQSGAEVKKPGASVKVSCKVSGYTLTE LSMHWVRQAPGKGLEWMGGFDPEDGETIYAQ KFQGRVTMTEDTSTDTAYMELSSLRSEDTAV YYCATDSAGYWYKFFQHWGQGTLVTVSS |
| AM3 VH | CDR-H1 Residues 31-35 of SEQ ID NO.: 2000 | ELSMH |
| AM3 VH | CDR-H2 Residues 50-66 of SEQ ID NO.: 2000 | GFDPEDGETIYAQKFQG |

TABLE 8-continued

VH sequences of IgG converted clones

| Protein region | SEQ ID NO | Sequence<br>1234567890123456789012345 67890 |
|---|---|---|
| AM3 VH CDR-H3 | Residues 99-110 of SEQ ID NO.: 2000 | DSAGYWYKFFQH |
| AM4 VH | SEQ ID NO: 2001 | EVQLVQSGAEVKKPGASVKVSCKVSGYTLTELSMHWVRQAPGKGLEWMGGFDPEHGETIYAQKFQGRVTMTEDTSTDTAYMELSSLRSEDTAVYYCATDSVSFWEKFFQHWGQGTLVTVSS |
| AM4 VH CDR-H1 | Residues 31-35 of SEQ ID NO.: 2001 | ELSMH |
| AM4 VH CDR-H2 | Residues 50-66 of SEQ ID NO.: 2001 | GFDPEHGETIYAQKFQG |
| AM4 VH CDR-H3 | Residues 99-110 of SEQ ID NO.: 2001 | DSVSFWEKFFQH |
| AM5 VH | SEQ ID NO: 2002 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDAGGYWYKFFQHWGQGTLVTVSS |
| AM5 VH CDR-H1 | Residues 31-35 of SEQ ID NO.: 2002 | ELSMH |
| AM5 VH CDR-H2 | Residues 50-66 of SEQ ID NO.: 2002 | GFDPEGGETIYAQKFQG |
| AM5 VH CDR-H3 | Residues 99-110 of SEQ ID NO.: 2002 | DAGGYWYKFFQH |
| AM6 VH | SEQ ID NO: 2003 | EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDTEGYWEKFFQHWGQGTLVTVSS |
| AM6 VH CDR-H1 | Residues 31-35 of SEQ ID NO.: 2003 | ELSMH |
| AM6 VH CDR-H2 | Residues 50-66 of SEQ ID NO.: 2003 | GFDPEGGETIYAQKFQG |
| AM6 VH CDR-H3 | Residues 99-110 of SEQ ID NO.: 2003 | DTEGYWEKFFQH |
| AM7 VH | SEQ ID NO: 2004 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSS |
| AM7 VH CDR-H1 | Residues 31-35 of SEQ ID NO.: 2004 | ELSMH |
| AM7 VH CDR-H2 | Residues 50-66 of SEQ ID NO.: 2004 | GFDPEDGETIYAQKFQG |
| AM7 VH CDR-H3 | Residues 99-110 of SEQ ID NO.: 2004 | DTVGYWEKFFQH |
| AM8 VH | SEQ ID NO: 2005 | EVQLVQSGAEVKKPGASVKVSCKVSGYTLSELSIHWVRQAPGKGLEWMGGFDPEDGETIYAQKFQGRVTMTEDTSTDTAYMELSSLRSEDTAVYYCATDSAGYWYKFFQHWGQGTLVTVSS |
| AM8 VH CDR-H1 | Residues 31-35 of SEQ ID NO.: 2005 | ELSIH |
| AM8 VH CDR-H2 | Residues 50-66 of SEQ ID NO.: 2005 | GFDPEDGETIYAQKFQG |
| AM8 VH CDR-H3 | Residues 99-110 of SEQ ID NO.: 2005 | DSAGYWYKFFQH |

TABLE 8-continued

VH sequences of IgG converted clones

| Protein | region | SEQ ID NO | Sequence 12345678901234567890123456789 0 |
|---|---|---|---|
| AM9 VH | | SEQ ID NO: 2006 | EVQLVQSGAEVKKPGASVKVSCKVSGYTLSELSMHWVRQAPGKGLEWMGGFDPEVGELIYAQKFQGRVTMTEDTSTDTAYMELSSLRSEDTAVYYCATDAGGFWYKFFQHWGPGTLVTVSS |
| AM9 VH | CDR-H1 | Residues 31-35 of SEQ ID NO.: 2006 | ELSMH |
| AM9 VH | CDR-H2 | Residues 50-66 of SEQ ID NO.: 2006 | GFDPEVGELIYAQKFQG |
| AM9 VH | CDR-H3 | Residues 99-110 of SEQ ID NO.: 2006 | DAGGFWYKFFQH |
| AM10 VH | | SEQ ID NO: 2007 | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSEGYWEKYFQHWGRGTLVTVSS |
| AM10 VH | CDR-H1 | Residues 31-35 of SEQ ID NO.: 2007 | ELSMH |
| AM10 VH | CDR-H2 | Residues 50-66 of SEQ ID NO.: 2007 | GFDPEDGETIYAQKFQG |
| AM10 VH | CDR-H3 | Residues 99-110 of SEQ ID NO.: 2007 | DSEGYWEKYFQH |

TABLE 9

VL sequences of IgG converted clones

| Protein | region | SEQ ID NO | Sequence 12345678901234567890123456789 0 |
|---|---|---|---|
| AM1 VL | | SEQ ID NO: 2008 | QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGTFVFGGGTKLTVL |
| AM1 VL | CDR-L1 | Residues 23-36 of SEQ ID NO.: 2008 | GSSTGAVTIDHYPY |
| AM1 VL | CDR-L2 | Residues 52-58 of SEQ ID NO.: 2008 | DTDDKHS |
| AM1 VL | CDR-L3 | Residues 101-109 of SEQ ID NO.: 2008 | LLDYGGTFV |
| AM2 VL | | SEQ ID NO: 2009 | QAVVTQEPSLTVSPGGTVTLTCGSSTGAVTIWHYPYWFQQKPGQAPRTLISDTNDKHSWTPARFSGSLLGGKAALTLSGAQPEDEAEYYCLLDYGGSFVFGGGTKLTVL |
| AM2 VL | CDR-L1 | Residues 23-36 of SEQ ID NO.: 2009 | GSSTGAVTIWHYPY |
| AM2 VL | CDR-L2 | Residues 52-58 of SEQ ID NO.: 2009 | DTNDKHS |
| AM2 VL | CDR-L3 | Residues 101-109 of SEQ ID NO.: 2009 | LLDYGGSFV |
| AM3 VL | | SEQ ID NO: 2010 | QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGTFVFGGGTKLTVL |

TABLE 9-continued

VL sequences of IgG converted clones

| Protein region | SEQ ID NO | Sequence<br>12345678901234567890123456789 0 |
|---|---|---|
| AM3 VL CDR-L1 | Residues 23-36 of SEQ ID NO.: 2010 | GSSTGAVTIDHYPY |
| AM3 VL CDR-L2 | Residues 52-58 of SEQ ID NO.: 2010 | DTDDKHS |
| AM3 VL CDR-L3 | Residues 101-109 of SEQ ID NO.: 2010 | LLDYGGTFV |
| AM4 VL | SEQ ID NO: 2011 | QAVVTQEPSLTVSPGGTVTLTCGSSTGSVTI DHYPYWFQQKPGQAPRTLISDTDDKHSWTPA RFSGSLLGGKAALTLSGAQPEDEAEYYCLLD YGGSFVFGGGTKLTVL |
| AM4 VL CDR-L1 | Residues 23-36 of SEQ ID NO.: 2011 | GSSTGSVTIDHYPY |
| AM4 VL CDR-L2 | Residues 52-58 of SEQ ID NO.: 2011 | DTDDKHS |
| AM4 VL CDR-L3 | Residues 101-109 of SEQ ID NO.: 2011 | LLDYGGSFV |
| AM5 VL | SEQ ID NO: 2012 | QAVVTQEPSLTVSPGGTVTLTCGSSTGTVTI DHYPYWFQQKPGQAPRTLISDTDDKHSWTPA RFSGSLLGGKAALTLSGAQPEDEAEYYCLLF YGGTVVFGGGTKLTVL |
| AM5 VL CDR-L1 | Residues 23-36 of SEQ ID NO.: 2012 | GSSTGTVTIDHYPY |
| AM5 VL CDR-L2 | Residues 52-58 of SEQ ID NO.: 2012 | DTDDKHS |
| AM5 VL CDR-L3 | Residues 101-109 of SEQ ID NO.: 2012 | LLFYGGTVV |
| AM6 VL | SEQ ID NO: 2013 | QAVVTQEPSLTVSPGGTVTLTCGSSTGAVTI DHYPYWFQQKPGQAPRTLISDTDDKHSWTPA RFSGSLLGGKAALTLSGAQPEDEAEYYCLLD YGGTFVFGGGTKLTVL |
| AM6 VL CDR-L1 | Residues 23-36 of SEQ ID NO.: 2013 | GSSTGAVTIDHYPY |
| AM6 VL CDR-L2 | Residues 52-58 of SEQ ID NO.: 2013 | DTDDKHS |
| AM6 VL CDR-L3 | Residues 101-109 of SEQ ID NO.: 2013 | LLDYGGTFV |
| AM7 VL | SEQ ID NO: 2014 | QAVVTQEPSLTVSPGGTVTLTCGSSTGTVTI DHYPYWFQQKPGQAPRTLISDTDDKHSWTPA RFSGSLLGGKAALTLSGAQPEDEAEYYCLLD YGGRFVFGGGTKLTVL |
| AM7 VL CDR-L1 | Residues 23-36 of SEQ ID NO.: 2014 | GSSTGTVTIDHYPY |
| AM7 VL CDR-L2 | Residues 52-58 of SEQ ID NO.: 2014 | DTDDKHS |
| AM7 VL CDR-L3 | Residues 101-109 of SEQ ID NO.: 2014 | LLDYGGRFV |
| AM8 VL | SEQ ID NO: 2015 | QAVVTQEPSLTVSPGGTVTLTCGSSTGAVTI DHYPYWFQQKPGQAPRTLISDTDDKHSWTPA RFSGSLLGGKAALTLSGAQPEDEAEYYCLLD YGGSFVFGGGTKLTVL |

TABLE 9-continued

VL sequences of IgG converted clones

| Protein | region | SEQ ID NO | Sequence<br>12345678901234567890123456 7890 |
|---|---|---|---|
| AM8 VL | CDR-L1 | Residues 23-36 of SEQ ID NO.: 2015 | GSSTGAVTIDHYPY |
| AM8 VL | CDR-L2 | Residues 52-58 of SEQ ID NO.: 2015 | DTDDKHS |
| AM8 VL | CDR-L3 | Residues 101-109 of SEQ ID NO.: 2015 | LLDYGGSFV |
| AM9 VL | | SEQ ID NO: 2016 | QAVVTQEPSLTVSPGGTVTLTCGSSTGAVTSGHYPYWFQQKPGQAPRTLISDTNDKHSWTPARFSGSLLGGKAALTLSGAQPEDEAEYYCLLFYGGTVVFGGGTKLTVL |
| AM9 VL | CDR-L1 | Residues 23-36 of SEQ ID NO.: 2016 | GSSTGAVTSGHYPY |
| AM9 VL | CDR-L2 | Residues 52-58 of SEQ ID NO.: 2016 | DTNDKHS |
| AM9 VL | CDR-L3 | Residues 101-109 of SEQ ID NO.: 2016 | LLFYGGTVV |
| AM10 VL | | SEQ ID NO: 2017 | QAVVTQEPSLTVSPGGTVTLTCGSSTGDVTIDHYPYWFQQKPGQAPRTLISDTDDKHSWTPARFSGSLLGGKAALTLSGAQPEDEAEYYCLLFYGGTLVFGGGTKLTVL |
| AM10 VL | CDR-L1 | Residues 23-36 of SEQ ID NO.: 2017 | GSSTGDVTIDHYPY |
| AM10 VL | CDR-L2 | Residues 52-58 of SEQ ID NO.: 2017 | DTDDKHS |
| AM10 VL | CDR-L3 | Residues 101-109 of SEQ ID NO.: 2017 | LLFYGGTLV |

Heavy and light chain pairs were prepared as follows in Table 10:

TABLE 10

Heavy and light chain pairs of AE10-6 affinity matured clones

| Clone name | HC | LC | Protein name |
|---|---|---|---|
| rHC + LC S4 clone 10 | AE10-6 AM1 | AE10-6 AM1 | AE10-6-AM1 |
| rHC + LC S4 clone 102 | AE10-6 AM2 | AE10-6 AM2 | AE10-6-AM2 |
| rHC + LC S4 clone 105 | AE10-6 AM3 | AE10-6 AM3 | AE10-6-AM3 |
| rHC + LC S4 clone 114 | AE10-6 AM4 | AE10-6 AM4 | AE10-6-AM4 |
| rHC + LC S4 clone 117 | AE10-6 AM5 | AE10-6 AM5 | AE10-6-AM5 |
| rHC + LC S4 clone 119 | AE10-6 AM6 | AE10-6 AM6 | AE10-6-AM6 |
| rHC + LC S4 clone 131 | AE10-6 AM7 | AE10-6 AM7 | AE10-6-AM7 |
| rHC + LC S4 clone 135 | AE10-6 AM8 | AE10-6 AM8 | AE10-6-AM8 |
| HC M2S5 clone 21 | AE10-6 AM9 | AE10-6 AM9 | AE10-6-AM9 |
| LC M2S5 clone 12 | AE10-6 AM10 | AE10-6 AM10 | AE10-6-AM10 |

Example 1.1.3

Affinity Maturation of the Fully Human Anti-Human Sclerostin Binding Protein MSL10

The MSL10 human binding protein to human TNF was affinity matured by in vitro display technology. The VH and VL sequence of the parental MSL10 antibody are provided below.

Parental MSL10 VH
(SEQ ID NO: 2018)
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTSS Parental MSL1.1 VL
(SEQ ID NO: 2019)
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGGGTKLTVL To improve the affinity of MSL10 to Sclerostin, hypermutated CDR residues were identified from other human antibody sequences in the IgBLAST database that also shared high identity to human germlines. The corresponding MSL10 CDR residues were then subjected to limited mutagenesis by PCR with primers having low degeneracy at these positions to create two antibody libraries in the scFv format suitable for surface display.

The tables below provides a list of amino acid sequences of VH (Table 14) and VL (Table 15) regions of affinity matured fully human Sclerostin antibodies derived from MSL10. Amino acid residues of individual CDRs of each VH sequence are indicated in bold.

TABLE 14

VH sequences of affinity matured MSL10 variants

| Clone | SEQ ID NO: | VH |
| --- | --- | --- |
| MSL10-AM1 | SEQ ID NO: 2020 | EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS |
| MSL10-AM2 VH | SEQ ID NO: 2021 | EVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS |
| MSL10-AM3 VH | SEQ ID NO: 2022 | EVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS |
| MSL10-AM4 VH | SEQ ID NO: 2023 | EVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS |
| MSL10-AM5 VH | SEQ ID NO: 2024 | EVQLVESGGGLVQPGRSLRLSCAASGFTFDDYALHWVRQAPGKGLEWVSGISWHGDFIDYADSVKGRFTISRDNAKNSLYLQMNSLRVEDTALYYCAGNNRGYGGLDVWGQGTTVTVSS |
| MSL10-AM6 VH | SEQ ID NO: 2025 | EVQLVESGGGLVQPGRSLRLSCAASGFTFDQYALHWVRQAPGKGLEWVSGINWDGDYIDYADSVKGRFTISRDNAKNSLYLQMNSLRVEDTALYYCAGNIRGYGGLDVWGQGTTVTVSS |
| MSL10-AM7 VH | SEQ ID NO: 2026 | EVQLVESGGGLVQPGRSLRLSCAASGFTFEDYALHWVRQAPGKGLEWVSGIGWNDDEIDYADSVKGRFTISRDNSKNSLYLQMNSLRVEDTALYYCAGNNRGYGGLDVWGQGTTVTVSS |
| MSL10-AM8 VH | SEQ ID NO: 2027 | EVQLVESGGGLVQPGRSLRLSCAASGFTFEDYALHWVRQAPGKGLEWVSGIGWDRDFIDYADSVKGRFTISRDNAKNSLYLQMNSLRVEDTALYYCAGNKIGYGGLDVWGQGTTVTVSS |
| MSL10-AM9 VH | SEQ ID NO: 2028 | EVQLVESGGGLVQPGRSLRLSCAASGFTFDDYALHWVRQAPGKGLEWVSGIGWDDDMIDYADSVKGRFTISRDNAKNSLYLQMNSLRVEDTALYYCAGNNRGYGGLDVWGQGTTVTVSS |
| MSL10-AM10 VH | SEQ ID NO: 2029 | EVQLVESGGGLVQPGRSLRLSCAASGFTFSDYALHWVRQAPGKGLEWVSGISWYGDDIDYADSVKGRFTISRDNAKNSLYLQMNSLRVEDTALYYCAGNIRGYGGLDVWGQGTTVTVSS |
| MSL10-AM11 VH | SEQ ID NO: 2030 | EVQLVESGGGLVQPGRSLRLSCAASGFTFDDYALHWVRQAPGKGLEWVSGISWHGDFIDYADSVKGRFTISRDNAKNSLYLQMNSLRVEDTALYYCAGNNRGYGGLDVWGQGTTVTVSS |
| MSL10-AM1.2VH | SEQ ID NO: 2031 | EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS |
| MSL10-AM2.2VH | SEQ ID NO: 2032 | EVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS |
| MSL10-AM3.2VH | SEQ ID NO: 2033 | EVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS |
| MSL10-AM4.2VL | SEQ ID NO: 2034 | EVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS |

TABLE 15

| VL sequences of affinity matured MSL10 variants | | |
|---|---|---|
| Clone | SEQ ID NO: | VH |
| MSL10-AM1 VL | SEQ ID NO: 2035 | QSVLTQPPSASGTPGQRVTISCSGSSSNIGRNTVNWYQQL PGTAPKLLIYSNNQRPSGVPDRFSGSKSGTSASLAISGLQ SEDEADYYCAAWDDNLESYVFGGGTKLTVL |
| MSL10-AM2 VL | SEQ ID NO: 2036 | QSVLTQPPSASGTPGQRVTISCSGSSSNIGGNTVNWYQQL PGTAPKLLIYSNNQRPSGVPDRFSGSKSGTSASLAISGLQ SEDEADYYCAAWDDSLEGSYVFGGGTKLTVL |
| MSL10-AM3 VL | SEQ ID NO: 2037 | QSVLTQPPSASGTPGQRVTISCSGSWSNIGSNTVNWYQQL PGTAPKLLIYNNNQRPSGVPDRFSGSKSGTSASLAISGLQ SEDEADYYCAAWDDSLSGEYVFGGGTKLTVL |
| MSL10-AM4 VL | SEQ ID NO: 2038 | QSVLTQPPSASGTPGQRVTISCSGSSSNIGSNTVNWYQQL PGTAPKLLIYNNNQRPSGVPDRFSGSKSGTSASLAISGLQ SEDEADYYCAAWDDSLDSYVFGGGTKLTVL |
| MSL10-AM5 VL | SEQ ID NO: 2039 | QSVLTQPPSASGTPGQRVTISCSGSWSNIGGNTVNWYQQL PGTAPKLLIYNNNQRPSGVPDRFSGSKSGTSASLAISGLQ SEDEADYYCAAWDDTLEGSYVFGGGTKLTVL |
| MSL10-AM6 VL | SEQ ID NO: 2040 | QSVLTQPPSASGTPGQRVTISCSGSWSNIGGNTVNWYQQL PGTAPKLLIYNNNQRPSGVPDRFSGSKSGTSASLAISGLQ SEDEADYYCAAWDDSLDGEYVFGGGTKLTVL |
| MSL10-AM7 VL | SEQ ID NO: 2041 | QSVLTQPPSASGTPGQRVTISCSGSSSNIGSNTVNWYQQL PGTAPKLLIYSNNQRPSGVPDRFSGSKSGTSASLAISGLQ SEDEADYYCAAWDDELELYVFGGGTKLTVL |
| MSL10-AM8 VL | SEQ ID NO: 2042 | QSVLTQPPSASGTPGQRVTISCSGSSSNIGTNTVNWYQQL PGTAPKLLIYSNNQRPSGVPDRFSGSKSGTSASLAISGLQ SEDEADYYCAAWDDQLEAYVFGGGTKLTVL |
| MSL10-AM9 VL | SEQ ID NO: 2043 | QSVLTQPPSASGTPGQRVTISCSGSSSNIGTNTVNWYQQL PGTAPKLLIYSNNQRPSGVPDRFSGSKSGTSASLAISGLQ SEDEADYYCAAWDDRLDEYVFGGGTKLTVL |
| MSL10-AM10 VL | SEQ ID NO: 2044 | QSVLTQPPSASGTPGQRVTISCSGSWSNIGSNTVNWYQQL PGTAPKLLIYSNNQRPSGVPDRFSGSKSGTSASLAISGLQ SEDEADYYCAAWDDSLDGAYVFGGGTKLTVL |
| MSL10-AM11 VL | SEQ ID NO: 2045 | QSVLTQPPSASGTPGQRVTISCSGSSSNIGGNTVNWYQQL PGTAPKLLIYSNNQRPSGVPDRFSGSKSGTSASLAISGLQ SEDEADYYCAAWDDILESYVFGGGTKLTVL |
| MSL10-AM1.2VL | SEQ ID NO: 2046 | QSVLTQPPSASGTPGQRVTISCSGSSSNIGRNTVNWYQQL PGTAPKLLIYSNNQRPSGVPDRFSGSKSGTSASLAISGLQ SEDEADYYCAAWDDNLESYVFGGGTKLTVLG |
| MSL10-AM2.2VL | SEQ ID NO: 2047 | QSVLTQPPSASGTPGQRVTISCSGSSSNIGGNTVNWYQQL PGTAPKLLIYSNNQRPSGVPDRFSGSKSGTSASLAISGLQ SEDEADYYCAAWDDSLEGSYVFGGGTKLTVLG |
| MSL10-AM3.2VL | SEQ ID NO: 2048 | QSVLTQPPSASGTPGQRVTISCSGSWSNIGSNTVNWYQQL PGTAPKLLIYNNNQRPSGVPDRFSGSKSGTSASLAISGLQ SEDEADYYCAAWDDSLSGEYVFGGGTKLTVLG |
| MSL10-AM4.2VL | SEQ ID NO: 2049 | QSVLTQPPSASGTPGQRVTISCSGSSSNIGSNTVNWYQQL PGTAPKLLIYNNNQRPSGVPDRFSGSKSGTSASLAISGLQ SEDEADYYCAAWDDSLDSYVFGGGTKLTVLG |

The table below (Table 16) provides a list of amino acid sequences of VH and VL of a fully human SOST antibody MSL10 Amino acid residues of individual CDRs of each VH and VL sequence are indicated in bold.

TABLE 16

List Of Amino Acid Sequences Of VH And VL Regions Of Fully Human SOST Antibodies

| Protein region | SEQ ID NO. | Sequence<br>12345678901234567890123456 7890 |
|---|---|---|
| MSL10 VH | SOST SEQ ID NO: 3 | EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS |
| MSL10CDR-H1 | Residues 31-35 of SEQ ID NO: 3 | DYALH |
| MSL10CDR-H2 | Residues 50-66 of SEQ ID NO: 3 | GISWHGDFIDYADSVKG |
| MSL10CDR-H3 | Residues 99-108 of SEQ ID NO: 3 | NNRGYGGLDV |
| MSL10 VL | SOST SEQ ID NO: 4 | QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG |
| MSL10CDR-L1 | Residues 23-35 of SEQ ID NO: 4 | SGSSSNIGSNTVN |
| MSL10CDR-L2 | Residues 51-57 of SEQ ID NO: 4 | SNNQRPS |
| MSL10CDR-L3 | Residues 90-101 of SEQ ID NO: 4 | AAWDDSLNGSYV |
| MSL17 VH | SOST SEQ ID NO: 5 | EVQLLESGGGLVKPGRSLRLSCVAYGFSLTGYSMNWVRQAPGKGLEWVSSISPNDTYRHYADSVKGRFTISRDNAKNSLYLQMNSLRAEDTAVYYCARDTNYRDSGGYFYDVFDIWGQGTMVTVSS |
| MSL17 CDR-H1 | Residues 31-35 of SEQ ID NO: 5 | GYSMN |
| MSL17 CDR-H2 | Residues 50-66 of SEQ ID NO: 5 | SISPNDTYRHYADSVKG |
| MSL17 CDR-H3 | Residues 99-115 of SEQ ID NO: 5 | DTNYRDSGGYFYDVFDI |
| MSL17 VL | SOST SEQ ID NO: 6 | SYELTQPPSVSVAPGETARVTCEGNNIGNKGVHWYQQKPGQAPVLVVYDDSDRPSGIPERFSGSNSGNTATLTISRVEAGDDADYYCQVWDSSSDVFGSGTKVTVLG |
| MSL17 CDR-L1 | Residues 23-33 of SEQ ID NO: 6 | EGNNIGNKGVH |
| MSL17 CDR-L2 | Residues 49-55 of SEQ ID NO: 6 | DDSDRPS |
| MSL17 CDR-L3 | Residues 88-96 of SEQ ID NO: 6 | QVWDSSSDV |
| MSL9-8 VH | SOST SEQ ID NO: 7 | EVQLVESGGGLVQPGGSLRLSCAASGFRFTDYWMTWVRQAPGKGPEWVANINEDGSKKHYADSVKDRFIISRDNAKKSLSLQMKRMRAEDTAVYYCAADLNPHWLVGWGQGTLVTVSS |
| MSL9-8 CDR-H1 | Residues 31-35 of SEQ ID NO: 7 | DYWMT |
| MSL9-8 CDR-H2 | Residues 50-66 of SEQ ID NO: 7 | NINEDGSKKHYADSVKD |
| MSL9-8 CDR-H3 | Residues 99-107 of SEQ ID NO: 7 | DLNPHWLVG |

TABLE 16-continued

List Of Amino Acid Sequences Of VH And VL Regions
Of Fully Human SOST Antibodies

| Protein region | SEQ ID NO. | Sequence<br>12345678901234567890123456789 0 |
|---|---|---|
| MSL9-8 VL | SOST SEQ ID NO: 8 | QPVLTQPPSVSVAPGKTARITCGGNNIGSRRVHWYQQKPGQAPVLVVYDDNDRPSGIPERFSGSKSGNTATLTISRVEAGDEADYYCQVWHSGRVFGTGTKVTVLG |
| MSL9-8 CDR-L1 | Residues 23-33 of SEQ ID NO: 8 | GGNNIGSRRVH |
| MSL9-8 CDR-L2 | Residues 49-55 of SEQ ID NO: 8 | DDNDRPS |
| MSL9-8 CDR-L3 | Residues 88-95 of SEQ ID NO: 8 | QVWHSGRV |
| MSK9 VH | SOST SEQ ID NO: 9 | EVQLLESGGGLVQPGGSLRLSCAASGFTFRSYWMSWVRQAPGKGLEWVASIKQDGSKKHYADSVKDRFIISRDNAKKSLSLQMKRMRAEDTAVYYCAADLNPHWLVGWGQGTLVTVSS |
| MSK9 CDR-H1 | Residues 31-35 of SEQ ID NO: 9 | SYWMS |
| MSK9 CDR-H2 | Residues 50-66 of SEQ ID NO: 9 | SIKQDGSKKHYADSVKD |
| MSK9 CDR-H3 | Residues 99-107 of SEQ ID NO: 9 | DLNPHWLVG |
| MSK9 VL | SOST SEQ ID NO: 10 | DIVMTQTPLSLPVTPGEPASISCRSSQSLLHSNGYNYLDWYLQKPGQSPQLLIYLGSKRASGVPDRFSGSGSGTDFTLKISRVGAEDVGVYYCMQGLQTPKAFGPGTKVDIKR |
| MSK9 CDR-L1 | Residues 24-39 of SEQ ID NO: 10 | RSSQSLLHSNGYNYLD |
| MSK9 CDR-L2 | Residues 55-61 of SEQ ID NO: 10 | LGSKRAS |
| MSK9 CDR-L3 | Residues 94-112 of SEQ ID NO: 10 | MQGLQTPKA |
| MSK13 VH | SOST SEQ ID NO: 11 | EMQLVQSGAEVKKPGASVKVSCKASGYTFSGYYMNWVRQAPGQGLEWMGWINPYSGAATYAQDFQGRITVTRDTSISTGYMELTRLTSTDTAVYYCARGGTITGASWYFDVWGRGTLVTVSS |
| MSK13 CDR-H1 | Residues 31-35 of SEQ ID NO: 11 | GYYMN |
| MSK13 CDR-H2 | Residues 50-66 of SEQ ID NO: 11 | WINPYSGAATYAQDFQG |
| MSK13 CDR-H3 | Residues 99-111 of SEQ ID NO: 11 | GGTITGASWYFDV |
| MSK13 VL | SOST SEQ ID NO: 12 | DIVMTQTPLSLPVTLGQPASISCRSSQSLVHSDGNTYLNWFQQRPGQSPRRLIYKVSNRDSGVPDRFSGSGSGTDFTLKISRVEAEDVGVYYCMQGTHWPQLTFGGGTKVEIKR |
| MSK13 CDR-L1 | Residues 24-39 of SEQ ID NO: 12 | RSSQSLVHSDGNTYLN |
| MSK13 CDR-L2 | Residues 55-61 of SEQ ID NO: 12 | KVSNRDS |
| MSK13 CDR-L3 | Residues 94-113 of SEQ ID NO: 12 | MQGTHWPQLT |

TABLE 16-continued

List Of Amino Acid Sequences Of VH And VL Regions
Of Fully Human SOST Antibodies

| Protein region | SEQ ID NO. | Sequence<br>1234567890123456789012345678901234567890 |
|---|---|---|
| MSK21 VH | SOST SEQ ID NO: 13 | EVQLQQSGPGLVKPSQTLSLTCAISGDSVSSNIVAWNWIRQSPSRGLEWLGRTYYTSKWFNQYAMSVKSRITINPDTSKNQVSLKLSSVTAADTAAYYCARVGGTYDFWSGYYRPYYYGMDVWGQGTMVTVSS |
| MSK21 CDR-H1 | Residues 31-37 of SEQ ID NO: 13 | SNIVAWN |
| MSK21 CDR-H2 | Residues 52-69 of SEQ ID NO: 13 | RTYYTSKWFNQYAMSVKS |
| MSK21 CDR-H3 | Residues 102-122 of SEQ ID NO: 13 | VGGTYDFWSGYYRPYYYGMDV |
| MSK21 VL | SOST SEQ ID NO: 14 | DIRLTQSPSSLSASIGDTVTISCRSSQPINTHLNWFRQLPGRAPELLIYGSSSLHTGVPSRFSGSGSGTDFTLTITSLQRGDFLTYYCQQTHRLPITFGQGTRLDIKR |
| MSK21 CDR-L1 | Residues 24-34 of SEQ ID NO: 14 | RSSQPINTHLN |
| MSK21 CDR-L2 | Residues 50-56 of SEQ ID NO: 14 | GSSSLHT |
| MSK21 CDR-L3 | Residues 89-97 of SEQ ID NO: 14 | QQTHRLPIT |

The sequences of the individual CDRs of the VH and VL regions of the fully human SOST antibodies in the above table can be aligned to provide consensus CDR sequences such as those in the table below (Table 17).

TABLE 17

Consensus Sequence of SOST Antibody CDRs

| CDR region | Sequence Identifier | Consensus Sequence |
|---|---|---|
| CDR-H1 | SEQ ID NO: 15 | $X_1\ X_2\ X_3\ X_4\ X_5\ X_6\ X_7$<br>D - - Y A L H (MSL10)<br>G - - Y S M N (MSL17)<br>D - - Y W M T (MSL9-8)<br>S - - Y W M S (MSK-9)<br>G - - Y Y M N (MSK-13)<br>S N I V A W N (MSK-21) |
| CDR-H2 | SEQ ID NO: 16 | $X_1\ X_2\ X_3\ X_4\ X_5\ X_6\ X_7\ X_8\ X_9\ X_{10}X_{11}X_{12}X_{13}X_{14}X_{15}X_{16}X_{17}X_{18}$<br>G I S W H G D F I - D Y A D S V K G (MSL10)<br>S I S P N D T Y R - H Y A D S V K G (MSL17)<br>N I N E D G S K K - H Y A D S V K D (MSL9-8)<br>S I K Q D G S K K - H Y A D S V K D (MSK-9)<br>W I N P Y S G A A - T Y A Q D F Q G (MSK-13)<br>R T Y Y T S K W F N Q Y A M S V K S (MSK-21) |
| CDR-H3 | SEQ ID NO: 17 | $X_1\ X_2\ X_3\ X_4\ X_5\ X_6\ X_7\ X_8\ X_9\ X_{10}X_{11}X_{12}X_{13}X_{14}X_{15}X_{16}X_{17}X_{18}X_{19}X_{20}X_{21}$<br>- - N N R G Y G G - - - - - - - - L D V (MSL10)<br>D T N Y R D S G G Y F Y - - - - D V F D I (MSL17)<br>D L N P H W L V G (MSL9-8)<br>D L N P H W L V G (MSK-9)<br>G G T I T G A S W Y - - - - - - - - F D V (MSK-13)<br>V G G T Y D F W S G Y Y R P Y Y Y G M D V (MSK-21) |

TABLE 17-continued

Consensus Sequence of SOST Antibody CDRs

| CDR region | Sequence Identifier | Consensus Sequence |
|---|---|---|
| CDR-L1 | SEQ ID NO: 18 | $X_1$ $X_2$ $X_3$ $X_4$ $X_5$ $X_6$ $X_7$ $X_8$ $X_9$ $X_{10}$ $X_{11}$ $X_{12}$ $X_{13}$ $X_{14}$ $X_{15}$ $X_{16}$<br>S G S S - - - S N I G S N T V N (MSL10)<br>E G N - - - - - N I G N K G V H (MSL17)<br>G G N - - - - - N I G S R R V H (MSL9-8)<br>R S S Q S L L H S N G Y N Y L D (MSK-9)<br>R S S Q S L V H S D G N T Y L N (MSK-13)<br>R S S Q - - - - - P I N T H L N (MSK-21) |
| CDR-L2 | SEQ ID NO: 19 | $X_1$ $X_2$ $X_3$ $X_4$ $X_5$ $X_6$ $X_7$<br>S N N Q R P S (MSL10)<br>D D S D R P S (MSL17)<br>D D N D R P S (MSL9-8)<br>L G S K R A S (MSK-9)<br>K V S N R D S (MSK-13)<br>G S S S L H T (MSK-21) |
| CDR-L3 | SEQ ID NO: 20 | $X_1$ $X_2$ $X_3$ $X_4$ $X_5$ $X_6$ $X_7$ $X_8$ $X_9$ $X_{10}$ $X_{11}$ $X_{12}$<br>A A W D D S L N G S Y V (MSL10)<br>Q V W D S S - - - S D V (MSL17)<br>Q V W H S G - - - - R V (MSL9-8)<br>M Q G L Q T P - - - K A (MSK-9)<br>M Q G T H W P - - Q L T (MSK-13)<br>Q Q - T H R L P I T (MSK-21) |

Sequence assignment key:
"CDRH1" sequences: "MSL10" residues 31-35 of SEQ ID NO: 3, "MSL17" residues 31-35 of SEQ ID NO: 5, "MSL9-8" residues 31-35 of SEQ ID NO: 7, "MSK-9" residues 31-35 of SEQ ID NO: 9, "MSK-13" residues 31-35 of SEQ ID NO: 11 and "MSK-21" residues 31-35 of SEQ ID NO: 13.
"CDRH2" sequences: "MSL10" residues 50-66 of SEQ ID NO: 3, "MSL17" residues 50-66 of SEQ ID NO: 5, "MSL9-8" residues 50-66 of SEQ ID NO: 7, "MSK-9" residues 50-66 of SEQ ID NO: 9, "MSK-13" residues 50-66 of SEQ ID NO: 11 and "MSK-21" residues 52-69 of SEQ ID NO: 13.
"CDRH3" sequences: "MSL10" residues 99-108 of SEQ ID NO: 3, "MSL17" residues 99-115 of SEQ ID NO: 5, "MSL9-8" residues 99-107 of SEQ ID NO: 7, "MSK-9" residues 99-107 of SEQ ID NO: 9, "MSK-13" residues 99-111 of SEQ ID NO: 11 and "MSK-21" residues 102-122 of SEQ ID NO: 13.
"CDRL1" sequences: "MSL10" residues 23-35 of SEQ ID NO: 4, "MSL17" residues 23-33 of SEQ ID NO: 6, "MSL9-8" residues 23-33 of SEQ ID NO: 8, "MSK-9" residues 24-39 of SEQ ID NO: 10, "MSK-13" residues 24-39 of SEQ ID NO: 12 and "MSK-21" residues 24-34 of SEQ ID NO: 14.
"CDRL2" sequences: "MSL10" residues 51-57 of SEQ ID NO: 4, "MSL17" residues 49-55 of SEQ ID NO: 6, "MSL9-8" residues 49-55 of SEQ ID NO: 8, "MSK-9" residues 55-61 of SEQ ID NO: 10, "MSK-13" residues 55-61 of SEQ ID NO: 12 and "MSK-21" residues 50-56 of SEQ ID NO: 14.
"CDRL3" sequences: "MSL10" residues 90-101 of SEQ ID NO: 4, "MSL17" residues 88-96 of SEQ ID NO: 6, "MSL9-8" residues 88-95 of SEQ ID NO: 8, "MSK-9" residues 94-112 of SEQ ID NO: 10, "MSK-13" residues 94-113 of SEQ ID NO: 12 and "MSK-21" residues 89-97 of SEQ ID NO: 14.

Example 1.2

Functional Characterization of Human SOST Antibodies

Example 1.2.1

Sclerostin Enzyme-Linked Immunosorbent Assay (ELISA) Protocols Direct Bind ELISA The following protocol was used to characterize the binding of SOST antibodies to human SOST by enzyme-linked immunosorbent assay (ELISA). ELISA plates were coated with 50 µl per well of goat anti-mouse IgG-Fc at 2 µg/ml overnight at 4° C. (Jackson cat #115-005-164). Plates were washed 3 times with PBS/Tween. 50 µl antibody diluted to 1 µg/ml in PBS/0.1% BSA was added to appropriate wells and incubated for 1 hour at room temperature (RT). Plates were washed 3 times with PBS/Tween. 50 µl of serial diluted biotin-SOST was added to appropriate wells and incubated for 1 hour at RT. Plates were washed 3 times with PBS/Tween. 50 µl of Streptavidin (Thermo Scientific cat #21126) diluted 1:10,000 in PBS/0.1% BSA was added to the appropriate wells and incubated for 1 hour at RT. Plates were washed 3 times with PBS/Tween. 50 µl of TMB (Zymed cat #002023) was added to the appropriate wells and the reaction allowed to proceed for 1 minute. The reaction was stopped with 50 µl 2N $H_2SO_4$ and absorbance was read at 450 nm.

Anti-Human Fc Capture ELISA

Antibody specific to anti-human Fc was diluted in 0.2 molar sodium bicarbonate buffer (pH 9.4) to 1 µg/ml. Plates were coated with 100 µl per well at RT for 2 hours. Blocking of additional binding capacity was conducted at RT for 1 hour by addition of 200 µl of 5% non-fat dry milk in PBS to each well. After washing plate, 100 µl of 0.5 µg/ml of diluted individual antibodies were added to each well in duplicate. Plates were incubated for 1 hour at RT and washed. 100 µl of 1:6 serially diluted biotin rh (rcyno/rrat/rmouse) sclerostin from 100 nM to 0.001 nM was added to each well and plate was incubated at RT for one hour. After washing, 1:10,000 diluted SA-HRP was added at 120n1 per well. A 15 minute incubation with SA-HRP at RT was followed by a wash. Finally, 120 µl of TMB substrate from Invitrogen (CAT #00-2023 Lot #425820A) was added to each well and color allowed to develop for 10 minutes. The reaction was stopped with 60 µl of 2N sulfuric acid. The plate was read at 450 nm, data collected and analyzed.

Anti-Biotin Capture ELISA

Goat anti-biotin (Sigma CAT B3640-1MG) was diluted in 0.2M sodium bicarbonate buffer (Pierce CAT 28382 Lot IA 109342) pH 9.4 to a concentration of 1 µg/ml. The plate was coated at 100 µl per well at RT for 2 hours. Blocking of additional binding capacity was conducted at RT for 1 hour by addition of 200 µl of 5% non-fat dry milk in PBS to each well. After washing, 100 µl of 2 µg/ml of biotin rh (rcyno/r rat/rmouse) sclerostin was added to each well. Samples were incubated at RT for 1 hour. After washing the plate, 100 µl of 1:6 serially diluted antibodies was added to the wells starting at 25 µg/ml. Samples were incubated at RT for one hour and the plate washed. 1:5000 diluted anti human Fc-HRP(Jackson CAT #109-036-098) was added at 120 µl per well and incubated at RT for 30 minutes. After washing, 120 µl of TMB substrate was added to each well (Invitrogen CAT #00-2023 Lot #425820A). Color was developed for 5 to 10 minutes. The reaction was stopped with 60 µl of 2N sulfuric acid. The plate was read at 450 nm, and data collected and analyzed. Several sclerostin specific antibodies were identified using this format (Table 11).

TABLE 11

Sclerostin antibodies

| Antibody name | EC50, hu scl (nM) |
|---|---|
| MSL10 | 0.4267 (capture) |
| MSL17 | 0.7783 (capture) |
| MSL9-8 | 12.34 (capture) |
| MSK9 | +(direct) |
| MSK13 | +(direct) |
| MSK21 | +(direct) |

Example 1.2.2

TopFlash Wnt Pathway Neutralization Assay

The following protocol was used to assess sclerostin neutralizing properties of mAbs and DVD-binding proteins via restoration of Wnt pathway activity inhibited by sclerostin. HEK 293A (Invitrogen, cat #:51-0036, lot #737470) cells were stably transduced with TopFlash Lentivirus (SA Biosciences, cat CLS 018L-1) and a selected 1G6 clone was further infected with Wnt-1 lentivirus (Origene Cat # SC303644), resulting in clones that co-express Luciferase and Wnt-1. One double stable clone (clone #14) has been maintained in culture medium: DMEM (Invitrogen Cat #11965-092) with 10% Qualified FBS (Invitrogen Cat #26140-079), Pen-Strep (Invitrogen Cat #15140-122), L-glutamine (Invitrogen Cat #25030-081 2 mM final), Sodium Pyruvate (Invitrogen Cat #11360-070 final 1 mM) and 2.5 µg/ml Puromycin (Invivogen Cat #ant-pr-1) in T75 flasks until 80-90% confluent on day of assay. Assay is performed in assay medium: culture medium without puromycin. Human sclerostin (Abbott), cyno sclerostin (Abbott), murine sclerostin and rat sclerostin were aliquoted and stored frozen at −80° C. On day 1 clone #14 cells are plated at 10,000 cells per well in 50 ul assay medium in black-sided, clear bottomed tissue culture treated 96 well plates (Costar #3603) and incubated at 37° C. overnight (20-24 hrs). The next day (day 2) the sclerostin stock is diluted to 60 nM (4×) for human and cyno and 200 nM (4×) for mouse and rat, in the assay medium. Anti-sclerostin antibodies are diluted, usually starting at 800 nM (4×) in the assay medium. Media is removed from plates with cells and replaced with 50 µl/well of fresh assay medium. Cells are next incubated for 1 hr with 25 µl of 60 nM (4×) for human and cyno sclerostin or 25 µl of 200 nM for mouse and rat sclerostin. After this anti-Sclerostin antibodies (25 µl of 4×) are added to cells and plates are incubated overnight at 37° C. (20-24 hrs). The final volume in each well is 100 µl. The following day (day 3) cells are washed once with 200 µl of PBS (RT). Promega Luciferase Kit #E1501 is used for cell lysis and Luciferase read out. Briefly, 5× cell lysis reagent (Promega, cat #E153A) is diluted with milliQ water to 1× and 20 µl is added to each well. To ensure a complete lysis, plate is rotated 500 rpm for 20 min. 100 µl of Luciferase assay reagent (1 vial cat #E151A substrate+10 ml cat #E152A assay buffer) is added to each well. Plate is read on TopCount machine (Program: Luciferase 96, Assay 17: 1 sec/well read).

AE10-6 AM2, AE10-6 AM3, AE10-6 AM5, AE10-6 AM6, AE10-6 AM7, and AE10-6 AM8 neutralized recombinant human sclerostin with IC50 of 1.5-7.7 nM, recombinant cynomolgus monkey sclerostin with IC50 of 4.7-21.1 nM. AE10-6 AM3, AE10-6 AM7, and AE10-6 AM8 neutralized recombinant mouse sclerostin with IC50 of 9.6-11.7 nM recombinant rat sclerostin with IC50 of 12.1 to 15.7 nM. MSL10 AM1-11 antibodies neutralized recombinant human sclerostin with IC50 of 3-23.3 nM. MSL10 AM6, MSL10 AM7, MSL10 AM8, MSL10 AM9, MSL10 AM10, MSL10 AM11neutralized recombinant cynomolgus monkey sclerostin with IC50 of 13.5-29.7 nM.

Example 1.2.3

Affinity Measurement of Sclerostin Antibodies by Surface Plasmon Resonance

The binding of antibodies or anti-sclerostin-TNF DVD to purified recombinant human, cynomolgus monkey (cyno), rat and mouse sclerostin and TNFα was determined by surface plasmon resonance-based measurements with a Biacore T100 or T200 instruments (GE Healthcare Life Sciences, Piscataway, N.J., USA) using running HBS-EP+ (10 mM HEPES [pH 7.4], 150 mM NaCl, 3 mM EDTA, and 0.005% surfactant P20) containing additional 150 mM NaCl, and/or 10 mg/ml carboxymethyl dextran, 0.1 mg/ml BSA at 25° C. All chemicals were obtained from GE Healthcare Life Sciences, Piscataway, N.J., USA or otherwise from a different source as described in the text. Approximately 10,000 RU (or 3000 RU when CM3 chip was used) of goat anti-mouse or anti-human IgG (Fcγ) fragment specific polyclonal antibody (Pierce Biotechnology Inc, Rockford, Ill.) diluted in 10 mM sodium acetate (pH 4.5) was directly immobilized across a CM5 (or CM3) research grade biosensor chip using a standard amine coupling kit according to manufacturer's instructions and procedures at 15 µg/ml. Unreacted moieties on the biosensor surface were blocked with ethanolamine. Modified carboxymethyl dextran surface in flowcells 2, 3 and 4 were used as a reaction surface. Modified carboxymethyl dextran in flow cell 1 was used as the reference surface. Biaevaluation T100 software version 2.0.2, GE Healthcare Life Sciences was used to simultaneously fit association and dissociation phases of all injections (using 1:1 fit analysis with local Rmax). Purified antibodies were diluted in running buffer for capture across goat anti-mouse or anti-human IgG specific reaction surfaces. Antibodies to be captured as a ligand (1 µg/ml) were injected over reaction matrices at a flow rate of 10 µl/minute. The association and dissociation rate constants, kon (unit M-1s-1) and koff (unit s-1) were determined under a continuous flow rate of 50 µl/minute. Rate constants were derived by making kinetic binding measurements at 6 to 8 different antigen concentrations ranging from 0.39-50 nM for sclerostin antigens and 0.195-25 nM for TNF. At the end of each cycle the surfaces were regenerated with 10s injection of 50 mM NaOH or/and by 10s injection of 10 mM Glycine pH1.5 at a flow rate of 100 µl/min. Instrument appropriate Biaevaluation software, GE Healthcare Life Sciences was used to simultaneously fit association and dissociation constants as well as $K_D$ (using 1:1 global fit analysis with local $R_{max}$). Binding was recorded as a function of time and kinetic rate constants are calculated. In this assay, on-rates as fast as $10^7$ $M^{-1}s^1$ and off-rates as slow as $10^{-6}s^{-1}$ can be measured. In cases when the off rate for certain antibodies/DVD-binding proteins was slower than $10^{-6}$ $s^{-1}$, $k_d$ was assumed to be lesser or equal to $1*10^{-6}s^{-1}$ and $K_D$ value was calculated under assumption of in such cases. was done by dividing the on-rate by $1*10^{-6}$ and was given as "at least".

The affinity and kinetic rates anti-sclerostin MSL10 clones for human and cyno sclerostin are provided in Table 12 below, while the affinity and kinetic rates of AE10-6 clones for all sclerostin species (human, cyno, rat and mouse) are provided in Table 13 (the MSL10 clones did not bind mouse and rat sclerostin).

TABLE 12

Affinity and kinetic rates of anti-sclerostin MSL 10 clones for human and cyno SOST

| name | antigen | $k_a$, $M^{-1}s^{-1}$ | $k_d$, $s^{-1}$ | $K_D$, M |
| --- | --- | --- | --- | --- |
| MSL10-.1 | hu sclerostin | 2.80E+04 | 7.80E-05 | 2.80E-09 |
| MSL10-AM1 | hu sclerostin | 5.20E+04 | 1.60E-05 | 3.00E-10 |
| MSL10-AM2 | hu sclerostin | 1.20E+05 | 7.60E-06 | 6.50E-11 |
| MSL10-AM3 | hu sclerostin | 8.40E+04 | 7.60E-05 | 9.00E-10 |
| MSL10-AM4 | hu sclerostin | 1.40E+05 | 7.30E-04 | 5.30E-09 |
| MSL10-AM5 | hu sclerostin | 7.70E+04 | 7.40E-05 | 9.70E-10 |
| MSL10-AM6 | hu sclerostin | 1.70E+05 | 5.50E-04 | 3.40E-09 |
| MSL10-AM7 | hu sclerostin | 1.70E+05 | 7.20E-05 | 4.20E-10 |
| MSL10-AM8 | hu sclerostin | 1.10E+05 | 7.70E-05 | 7.30E-10 |
| MSL10-AM9 | hu sclerostin | 9.60E+04 | 5.20E-06 | 5.40E-11 |
| MSL10-AM10 | hu sclerostin | 1.30E+05 | 3.90E-05 | 2.90E-10 |
| MSL10-AM11 | hu sclerostin | 8.80E+04 | 7.40E-05 | 8.50E-10 |
| MSL10-AM2.2 | hu sclerostin | 3.40E+05 | 1.10E-04 | 3.30E-10 |
| MSL10-AM3.2 | hu sclerostin | 2.80E+05 | 2.50E-04 | 9.00E-10 |
| MSL10-.1 | cyno sclerostin | 3.40E+05 | 9.90E-05 | 2.90E-09 |
| MSL10-AM1 | cyno sclerostin | 5.40E+04 | 2.30E-05 | 4.20E-10 |
| MSL10-AM2 | cyno sclerostin | 1.10E+05 | 8.80E-05 | 7.70E-10 |
| MSL10-AM3 | cyno sclerostin | 7.70E+04 | 1.00E-04 | 1.30E-09 |
| MSL10-AM4 | cyno sclerostin | 1.30E+05 | 7.30E-04 | 5.60E-09 |
| MSL10-AM5 | cyno sclerostin | 8.20E+04 | 8.70E-05 | 1.10E-09 |
| MSL10-AM2.2 | cyno sclerostin | 6.00E+05 | 6.70E-05 | 1.10E-10 |
| MSL10-AM3.2 | cyno sclerostin | 3.00E+05 | 1.00E-04 | 3.60E-10 |

TABLE 13

Affinity and kinetic rates of anti-sclerostin AE10-6 clones for human and cyno SOST

| name | antigen | $k_a$, $M^{-1}s^{-1}$ | $k_d$, $s^{-1}$ | $K_D$, M |
| --- | --- | --- | --- | --- |
| AE10-6-AM2 | hu sclerostin | 3.40E+06 | 2.70E-05 | 8.10E-12 |
| AE10-6-AM3 | hu sclerostin | 7.00E+06 | 3.80E-06 | 5.40E-13 |
| AE10-6-AM5 | hu sclerostin | 4.30E+06 | 1.30E-05 | 3.00E-12 |
| AE10-6-AM6 | hu sclerostin | 9.10E+06 | 1.20E-05 | 1.30E-12 |
| AE10-6-AM7 | hu sclerostin | 7.10E+06 | 2.10E-06 | 3.00E-13 |
| AE10-6-AM8 | hu sclerostin | 7.40E+06 | 9.70E-06 | 1.30E-12 |
| AE10-6-AM2 | Cyno sclerostin | 3.60E+06 | 2.60E-05 | 7.10E-12 |
| AE10-6-AM3 | Cyno sclerostin | 6.90E+06 | 1.60E-06 | 2.40E-13 |
| AE10-6-AM5 | Cyno sclerostin | 5.20E+06 | 7.60E-06 | 1.50E-12 |
| AE10-6-AM6 | Cyno sclerostin | 7.90E+06 | 7.00E-06 | 8.80E-13 |
| AE10-6-AM7 | Cyno sclerostin | 7.00E+06 | <1e-7 | <1.4E-13 |
| AE10-6-AM8 | Cyno sclerostin | 7.70E+06 | 3.00E-06 | 3.90E-13 |
| AE10-6-AM2 | ms sclerostin | 2.10E+07 | 2.00E-03 | 9.40E-11 |
| AE10-6-AM3 | ms sclerostin | 1.00E+07 | 5.50E-05 | 5.50E-12 |
| AE10-6-AM5 | ms sclerostin | 7.00E+06 | 1.10E-04 | 1.60E-11 |
| AE10-6-AM6 | ms sclerostin | 3.20E+07 | 8.70E-04 | 2.70E-11 |
| AE10-6-AM7 | ms sclerostin | 1.30E+07 | 1.20E-04 | 9.30E-12 |
| AE10-6-AM8 | ms sclerostin | 1.10E+07 | 8.20E-05 | 7.40E-12 |
| AE10-6-AM2 | rat sclerostin | 7.60E+06 | 8.80E-04 | 1.20E-10 |
| AE10-6-AM3 | rat sclerostin | 1.90E+06 | 1.90E-05 | 1.00E-11 |
| AE10-6-AM5 | rat sclerostin | 1.30E+06 | 7.50E-05 | 5.60E-11 |
| AE10-6-AM6 | rat sclerostin | 1.90E+06 | 1.80E-04 | 9.80E-11 |
| AE10-6-AM7 | rat sclerostin | 1.80E+06 | 4.60E-05 | 2.60E-11 |
| AE10-6-AM8 | rat sclerostin | 1.80E+06 | 5.90E-05 | 3.40E-11 |

Example 2

Pharmacokinetic Analysis of SOST Antibodies in Rat

Pharmacokinetic studies of human anti-human SOST antibodies are carried out in Sprague Dawley rats. Male rats are dosed intravenously with a single dose of 4 mg/kg of antibody proteins and serum samples are analyzed using antigen capture based chemiluminescent MSD (Meso Scale Discovery) method. Pharmacokinetic parameters are calculated by non-compartmental analysis using WinNonlin Example 2.2.1

Preparation of Rat Serum

Surgically altered (jugular vein cannulated, JVC) and regular male Sprague-Dawley Rats (approximately seven weeks old, weighing 240-390 grams) are purchased from Charles River Laboratories (Wilmington, Mass.). The animals are housed in rooms maintained at constant temperature and humidity under 12 hour light/dark cycle, fed with normal rodent chow and are allowed food and water ad libitum. Hydration and clinical conditions of the animals are monitored daily.

Blood samples are collected (0.2 mL) at various time-points, allowed to clot for 30 minutes at room temperature, and centrifuged for 8 minutes at 13,200 rpm. Serum is transferred to eppendorf tubes and stored frozen at −80° C.

Example 2.2.2

MSD Assay Used to Quantify SOST Antibody in PK Serum Samples

MSD streptavidin plates (Meso Scale Discovery) are washed with phosphate buffered saline containing 0.05% Tween-20 (diluted from 10×PBS, Abbott Bioresearch Center, Media Room, Worcester, Mass. and Tween-20, Sigma, St. Louis, Mo.). Plates are blocked with 150 μL/well blocking solution (MSD Block, Meso Scale Discovery, diluted to 3% final concentration in PBS) for 1 hour, covered, with shaking (600 rpm) at room temperature.

Prior to analysis, rat serum samples are thawed on ice, mixed gently, and centrifuged at 14,000 rpm for 3 minutes at 4° C. in an eppendorf centrifuge. Standard curve and control samples are prepared in rat serum. Study samples, standard curve samples, blanks, and quality control samples are incubated in solution in a separate 2 mL deep well 96-well plate (Corning, Corning, N.Y.) 1:1:1=V:V:V with biotinylated human SOST (0.1 ug/mL in assay buffer) and sulfo-tagged goat anti-human IgG (Meso Scale Discovery, 1 μg/mL in assay buffer) for 1 hour at room temperature. The samples are then transferred to the MSD plates and incubated for an additional hour with shaking (600 rpm) at room temperature. The MSD plates are washed and developed with 2× Read Buffer (Meso Scale Discovery). Chemiluminiscence is measured within ten minutes on the MSD Sector Imager 6000.

Standard curves are analyzed using four-parameter logistic fit and sample concentrations are calculated by XLfit4 software version 2.2.1 Build 16, (Microsoft Corporation, Redmond, Wash.). Pharmacokinetic parameters are calculated for each animal using Winonlin software version 5.0.1 (Pharsight Corporation, Mountain View, Calif.) by noncompartmental analysis.

Example 3

Generation of TNF/SOST DVD-Binding Proteins

Example 3.1

Construction Of TNF/SOST DVD-Binding Protein DNA Constructs

Anti-TNF antibody variable domains from human antibody D2E7, deimmunized D2E7, mouse or humanized antibody MAK199, and mouse or humanized antibody MAK195 were combined with multiple SOST antibody variable domains by overlapping PCR amplification with intervening linker DNA sequences. The amplified PCR products were subcloned into expression vectors suitable for transient expression in HEK293 cells and the open reading frame regions are confirmed by sequencing before DVD-binding protein expression.

Example 3.2

Expression and Production of TNF/SOST DVD-Binding Proteins

All DVD-binding protein cDNA constructs were sequenced, expanded in *E. coli* and DNA purified using Qiagen Hispeed Maxi Preps (CAT #12662, QIAGEN). DVD-binding protein DNA was transfected into log phase 293E cells ($0.5 \times 10^6$/ml, viability >95%) by mixing PEI and DNA @ 2:1 ratio with 0.2 μg/ml heavy chain DNA and 0.3 μg/ml light chain DNA. DNA:PEI complex was formed at room temperature in TC hood for fifteen minutes before adding to 293E cells. Twenty four later, 0.5% TN1 was added to 293E cells. At day five, supernatants were collected for human IgG1 titer measurement. Cell supernatant was harvested at day seven and filtered through a 0.2 μM PES filter. Supernatant was purified by using Protein A Sepharose Affinity Chromatography according to the manufacturer's instruction. Purified DVD-binding proteinss were eluted from the column by 0.1 M glycine (pH 2.99), buffered by 2 M tris-HCl or phosphate and/or dialyzed into 15 mM histidine buffer (pH 6.0) immediately. The binding proteins were quantitated by A280 and analyzed by mass spectrometry and SEC.

Example 3.3

Sequences of TNF/SOST DVD-Binding Constructs

Amino acid sequence of heavy chain and light chain of DVD-binding proteins capable of binding human TNF and SOST were determined. The amino acid sequences of variable heavy chains, variable light chains, and constant regions of TNF/SOST DVD-binding proteins are provided in the table below (Table 18).

TABLE 18

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Heavy Variable DVD2014H | AB247VH | AB387VH | SEQ ID NO: 21 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSSGGGGSGGGGSEVQLVESGGGL VQPGGSLRLSCTASGFTFDDYALHWVRQA PGKGLEWVSGISWHGDFIDYADSVKGRFT ISRDNSKNTLYLQMNGLRVEDMAIYYCAG NNRGYGGLDVWGQGTTVTVSS |
| VH | | | SEQ ID NO: 22 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| Linker | | | SEQ ID NO: 23 | GGGGSGGGGS |
| VH | | | SEQ ID NO: 24 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 25 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890 |
|---|---|---|---|---|
| DVD-Binding Protein Light Variable DVD2014L | AB247VL | AB387VL | SEQ ID NO: 26 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKRGGSGGGGS GQSGLTQPPSASGTPGQRVTISCSGSSSN IGSNTVNWYQQLPGTAPKLLIYSNNQRPS GVPDRFSGSKSGTSASLAISGLQSEDEAD YYCAAWDDSLNGSYVFGTGTKVTVLG |
| VL | | | SEQ ID NO: 27 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKR |
| Linker | | | SEQ ID NO: 28 | GGSGGGGSG |
| VL | | | SEQ ID NO: 29 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 30 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2015H | AB387VH | AB247VH | SEQ ID NO: 31 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSGGGGSGGGGSEIQLVQSGSELKKPGA SVKVSCKASGYTFTNYGMNWVRQAPGQGL EWMGWINTYTGEPTYADDFKGRFVFSLDT SVSTAYLQISSLKAEDTAVYFCARKFLTT VVVTDYAMDYWGQGTTVTVSS |
| VH | | | SEQ ID NO: 32 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 33 | GGGGSGGGGS |
| VH | | | SEQ ID NO: 34 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| CH | | | SEQ ID NO: 35 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 |
|---|---|---|---|---|
| DVD-Binding Protein Light Variable DVD2015L | AB387VL | AB247VL | SEQ ID NO: 36 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGGSG GGGSGDIQMTQSPSSLSASVGDRVTITCR ASQDISNYLNWYQQKPGKTVKLLIYYTSR LQSGVPSRFSGSGSGTDYTLTISSLQPED FATYFCQQGNTLPPTFGQGTKLEIKR |
| VL | | | SEQ ID NO: 37 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 38 | GGSGGGGSG |
| VL | | | SEQ ID NO: 39 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKR |
| CL | | | SEQ ID NO: 40 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2016H | AB247VH | AB387VH | SEQ ID NO: 41 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSSASTKGPEVQLVESGGGLVQPG GSLRLSCTASGFTFDDYALHWVRQAPGKG LEWVSGISWHGDFIDYADSVKGRFTISRD NSKNTLYLQMNGLRVEDMAIYYCAGNNRG YGGLDVWGQGTTVTVSS |
| VH | | | SEQ ID NO: 42 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| Linker | | | SEQ ID NO: 43 | ASTKGP |
| VH | | | SEQ ID NO: 44 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 45 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD-Binding Protein Light Variable DVD2016L | AB247VL | AB387VL | SEQ ID NO: 46 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 47 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKR |
| Linker | | | SEQ ID NO: 48 | TVAAP |
| VL | | | SEQ ID NO: 49 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 50 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2017H | AB387VH | AB247VH | SEQ ID NO: 51 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEIQLVQSGSELKKPGASVKV SCKASGYTFTNYGMNWVRQAPGQGLEWMG WINTYTGEPTYADDFKGRFVFSLDTSVST AYLQISSLKAEDTAVYFCARKFLTTVVVT DYAMDYWGQGTTVTVSS |
| VH | | | SEQ ID NO: 52 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 53 | ASTKGP |
| VH | | | SEQ ID NO: 54 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| CH | | | SEQ ID NO: 55 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 |
|---|---|---|---|---|
| DVD-Binding Protein Light Variable DVD2017L | AB387VL | AB247VL | SEQ ID NO: 56 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASQ DISNYLNWYQQKPGKTVKLLIYYTSRLQS GVPSRFSGSGSGTDYTLTISSLQPEDFAT YFCQQGNTLPPTFGQGTKLEIKR |
| VL | | | SEQ ID NO: 57 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 58 | QPKAAP |
| VL | | | SEQ ID NO: 59 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKR |
| CL | | | SEQ ID NO: 60 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2018H | AB247VH | AB387VH | SEQ ID NO: 61 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSSASTKGPEVQLVESGGGLVQPG GSLRLSCTASGFTFDDYALHWVRQAPGKG LEWVSGISWHGDFIDYADSVKGRFTISRD NSKNTLYLQMNGLRVEDMAIYYCAGNNRG YGGLDVWGQGTTVTVSS |
| VH | | | SEQ ID NO: 62 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| Linker | | | SEQ ID NO: 63 | ASTKGP |
| VH | | | SEQ ID NO: 64 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 65 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2018L | AB247VL | AB387VL | SEQ ID NO: 66 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKRTVAAPSVF IFPPQSGLTQPPSASGTPGQRVTISCSGS SSNIGSNTVNWYQQLPGTAPKLLIYSNNQ RPSGVPDRFSGSKSGTSASLAISGLQSED EADYYCAAWDDSLNGSYVFGTGTKVTVLG |
| VL | | | SEQ ID NO: 67 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKR |
| Linker | | | SEQ ID NO: 68 | TVAAPSVFIFPP |
| VL | | | SEQ ID NO: 69 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 70 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2019H | AB387VH | AB247VH | SEQ ID NO: 71 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEIQLVQSGSELKKPGASVKV SCKASGYTFTNYGMNWVRQAPGQGLEWMG WINTYTGEPTYADDFKGRFVFSLDTSVST AYLQISSLKAEDTAVYFCARKFLTTVVVT DYAMDYWGQGTTVTVSS |
| VH | | | SEQ ID NO: 72 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 73 | ASTKGP |
| VH | | | SEQ ID NO: 74 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| CH | | | SEQ ID NO: 75 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence |
|---|---|---|---|---|
| DVD-Binding Protein Light Variable DVD2019L | AB387VL | AB247VL | SEQ ID NO: 76 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APSVTLFPPDIQMTQSPSSLSASVGDRVT ITCRASQDISNYLNWYQQKPGKTVKLLIY YTSRLQSGVPSRFSGSGSGTDYTLTISSL QPEDFATYFCQQGNTLPPTFGQGTKLEIK R |
| VL | | | SEQ ID NO: 77 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 78 | QPKAAPSVTLFPP |
| VL | | | SEQ ID NO: 79 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKR |
| CL | | | SEQ ID NO: 80 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2020H | AB247VH | AB387VH | SEQ ID NO: 81 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSSASTKGPSVFPLAPEVQLVESG GGLVQPGGSLRLSCTASGFTFDDYALHWV RQAPGKGLEWVSGISWHGDFIDYADSVKG RFTISRDNSKNTLYLQMNGLRVEDMAIYY CAGNNRGYGGLDVWGQGTTVTVSS |
| VH | | | SEQ ID NO: 82 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| Linker | | | SEQ ID NO: 83 | ASTKGPSVFPLAP |
| VH | | | SEQ ID NO: 84 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 85 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2020L | AB247VL | AB387VL | SEQ ID NO: 86 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 87 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKR |
| Linker | | | SEQ ID NO: 88 | TVAAP |
| VL | | | SEQ ID NO: 89 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 90 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2021H | AB387VH | AB247VH | SEQ ID NO: 91 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPSVFPLAPEIQLVQSGSELKK PGASVKVSCKASGYTFTNYGMNWVRQAPG QGLEWMGWINTYTGEPTYADDFKGRFVFS LDTSVSTAYLQISSLKAEDTAVYFCARKF LTTVVVTDYAMDYWGQGTTVTVSS |
| VH | | | SEQ ID NO: 92 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 93 | ASTKGPSVFPLAP |
| VH | | | SEQ ID NO: 94 | EIQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| CH | | | SEQ ID NO: 95 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable DVD2021L | AB387VL | AB247VL | SEQ ID NO: 96 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASQ DISNYLNWYQQKPGKTVKLLIYYTSRLQS GVPSRFSGSGSGTDYTLTISSLQPEDFAT YFCQQGNTLPPTFGQGTKLEIKR |
| VL | | | SEQ ID NO: 97 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 98 | QPKAAP |
| VL | | | SEQ ID NO: 99 | DIQMTQSPSSLSASVGDRVTITCRASQDI SNYLNWYQQKPGKTVKLLIYYTSRLQSGV PSRFSGSGSGTDYTLTISSLQPEDFATYF CQQGNTLPPTFGQGTKLEIKR |
| CL | | | SEQ ID NO: 100 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2022H | AB365VH | AB387VH | SEQ ID NO: 101 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSSGGGGSGGGGSEVQLVESGGGL VQPGGSLRLSCTASGFTFDDYALHWVRQA PGKGLEWVSGISWHGDFIDYADSVKGRFT ISRDNSKNTLYLQMNGLRVEDMAIYYCAG NNRGYGGLDVWGQGTTVTVSS |
| VH | | | SEQ ID NO: 102 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| Linker | | | SEQ ID NO: 103 | GGGGSGGGGS |
| VH | | | SEQ ID NO: 104 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 105 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456 7890 |
|---|---|---|---|---|
| DVD-Binding Protein Light Variable DVD2022L | AB365VL | AB387VL | SEQ ID NO: 106 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKRGGSGGGGS GQSGLTQPPSASGTPGQRVTISCSGSSSN IGSNTVNWYQQLPGTAPKLLIYSNNQRPS GVPDRFSGSKSGTSASLAISGLQSEDEAD YYCAAWDDSLNGSYVFGTGTKVTVLG |
| VL | | | SEQ ID NO: 107 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKR |
| Linker | | | SEQ ID NO: 108 | GGSGGGGSG |
| VL | | | SEQ ID NO: 109 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 110 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2023H | AB387VH | AB365VH | SEQ ID NO: 111 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSGGGGSGGGGSEVQLVQSGSELKKPGA SVKVSCKASGYTFTNYGMNWVRQAPGQGL EWMGWINTYTGEPTYADDFKGRFVFSLDT SVSTAYLQISSLKAEDTAVYFCARKFLTT VVVTDYAMDYWGQGTTVTVSS |
| VH | | | SEQ ID NO: 112 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 113 | GGGGSGGGGS |
| VH | | | SEQ ID NO: 114 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| CH | | | SEQ ID NO: 115 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2023L | AB387VL | AB365VL | SEQ ID NO: 116 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGGGSG GGGSGDIQMTQSPSSLSASVGDRVTITCR ASQDISNYLNWYQQKPGKAPKLLIYYTSR LQSGVPSRFSGSGSGTDYTLTISSLQPED FATYYCQQGNTLPPTFGQGTKLEIKR |
| VL | | | SEQ ID NO: 117 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 118 | GGSGGGGSG |
| VL | | | SEQ ID NO: 119 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKR |
| CL | | | SEQ ID NO: 120 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2024H | AB365VH | AB387VH | SEQ ID NO: 121 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSSASTKGPEVQLVESGGGLVQPG GSLRLSCTASGFTFDDYALHWVRQAPGKG LEWVSGISWHGDFIDYADSVKGRFTISRD NSKNTLYLQMNGLRVEDMAIYYCAGNNRG YGGLDVWGQGTTVTVSS |
| VH | | | SEQ ID NO: 122 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| Linker | | | SEQ ID NO: 123 | ASTKGP |
| VH | | | SEQ ID NO: 124 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 125 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2024L | AB365VL | AB387VL | SEQ ID NO: 126 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 127 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKR |
| Linker | | | SEQ ID NO: 128 | TVAAP |
| VL | | | SEQ ID NO: 129 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 130 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2025H | AB387VH | AB365VH | SEQ ID NO: 131 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEVQLVQSGSELKKPGASVKV SCKASGYTFTNYGMNWVRQAPGQGLEWMG WINTYTGEPTYADDFKGRFVFSLDTSVST AYLQISSLKAEDTAVYFCARKFLTTVVVT DYAMDYWGQGTTVTVSS |
| VH | | | SEQ ID NO: 132 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 133 | ASTKGP |
| VH | | | SEQ ID NO: 134 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| CH | | | SEQ ID NO: 135 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2025L | AB387VL | AB365VL | SEQ ID NO: 136 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASQ DISNYLNWYQQKPGKAPKLLIYYTSRLQS GVPSRFSGSGSGTDYTLTISSLQPEDFAT YYCQQGNTLPPTFGQGTKLEIKR |
| VL | | | SEQ ID NO: 137 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 138 | QPKAAP |
| VL | | | SEQ ID NO: 139 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKR |
| CL | | | SEQ ID NO: 140 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2026H | AB365VH | AB387VH | SEQ ID NO: 141 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSSASTKGPEVQLVESGGGLVQPG GSLRLSCTASGFTFDDYALHWVRQAPGKG LEWVSGISWHGDFIDYADSVKGRFTISRD NSKNTLYLQMNGLRVEDMAIYYCAGNNRG YGGLDVWGQGTTVTVSS |
| VH | | | SEQ ID NO: 142 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| Linker | | | SEQ ID NO: 143 | ASTKGP |
| VH | | | SEQ ID NO: 144 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 145 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence |
|---|---|---|---|---|
| DVD-Binding Protein Light Variable DVD2026L | AB365VL | AB387VL | SEQ ID NO: 146 | DIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIKRTVAAPSVFIFPPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG |
| VL | | | SEQ ID NO: 147 | DIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIKR |
| Linker | | | SEQ ID NO: 148 | TVAAPSVFIFPP |
| VL | | | SEQ ID NO: 149 | QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG |
| CL | | | SEQ ID NO: 150 | QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| DVD-Binding Protein Heavy Variable DVD2027H | AB387VH | AB365VH | SEQ ID NO: 151 | EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPEVQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS |
| VH | | | SEQ ID NO: 152 | EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS |
| Linker | | | SEQ ID NO: 153 | ASTKGP |
| VH | | | SEQ ID NO: 154 | EVQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS |
| CH | | | SEQ ID NO: 155 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890 |
|---|---|---|---|---|
| DVD-Binding Protein Light Variable DVD2027L | AB387VL | AB365VL | SEQ ID NO: 156 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APSVTLFPPDIQMTQSPSSLSASVGDRVT ITCRASQDISNYLNWYQQKPGKAPKLLIY YTSRLQSGVPSRFSGSGSGTDYTLTISSL QPEDFATYYCQQGNTLPPTFGQGTKLEIK R |
| VL | | | SEQ ID NO: 157 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 158 | QPKAAPSVTLFPP |
| VL | | | SEQ ID NO: 159 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKR |
| CL | | | SEQ ID NO: 160 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2028H | AB365VH | AB387VH | SEQ ID NO: 161 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSSASTKGPSVFPLAPEVQLVESG GGLVQPGGSLRLSCTASGFTFDDYALHWV RQAPGKGLEWVSGISWHGDFIDYADSVKG RFTISRDNSKNTLYLQMNGLRVEDMAIYY CAGNNRGYGGLDVWGQGTTVTVSS |
| VH | | | SEQ ID NO: 162 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| Linker | | | SEQ ID NO: 163 | ASTKGPSVFPLAP |
| VH | | | SEQ ID NO: 164 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 165 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2028L | AB365VL | AB387VL | SEQ ID NO: 166 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 167 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKR |
| Linker | | | SEQ ID NO: 168 | TVAAP |
| VL | | | SEQ ID NO: 169 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 170 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2029H | AB387VH | AB365VH | SEQ ID NO: 171 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPSVFPLAPEVQLVQSGSELKK PGASVKVSCKASGYTFTNYGMNWVRQAPG QGLEWMGWINTYTGEPTYADDFKGRFVFS LDTSVSTAYLQISSLKAEDTAVYFCARKF LTTVVVTDYAMDYWGQGTTVTVSS |
| VH | | | SEQ ID NO: 172 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 173 | ASTKGPSVFPLAP |
| VH | | | SEQ ID NO: 174 | EVQLVQSGSELKKPGASVKVSCKASGYTF TNYGMNWVRQAPGQGLEWMGWINTYTGEP TYADDFKGRFVFSLDTSVSTAYLQISSLK AEDTAVYFCARKFLTTVVVTDYAMDYWGQ GTTVTVSS |
| CH | | | SEQ ID NO: 175 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456 7890 |
|---|---|---|---|---|
| DVD-Binding Protein Light Variable DVD2029L | AB387VL | AB365VL | SEQ ID NO: 176 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASQ DISNYLNWYQQKPGKAPKLLIYYTSRLQS GVPSRFSGSGSGTDYTLTISSLQPEDFAT YYCQQGNTLPPTFGQGTKLEIKR |
| VL | | | SEQ ID NO: 177 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 178 | QPKAAP |
| VL | | | SEQ ID NO: 179 | DIQMTQSPSSLSASVGDRVTITCRASQDI SNYLNWYQQKPGKAPKLLIYYTSRLQSGV PSRFSGSGSGTDYTLTISSLQPEDFATYY CQQGNTLPPTFGQGTKLEIKR |
| CL | | | SEQ ID NO: 180 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2030H | AB388VH | AB387VH | SEQ ID NO: 181 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSSGGGGSGGGGSEVQLVESGGGL VQPGGSLRLSCTASGFTFDDYALHWVRQA PGKGLEWVSGISWHGDFIDYADSVKGRFT ISRDNSKNTLYLQMNGLRVEDMAIYYCAG NNRGYGGLDVWGQGTTVTVSS |
| VH | | | SEQ ID NO: 182 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSS |
| Linker | | | SEQ ID NO: 183 | GGGGSGGGGS |
| VH | | | SEQ ID NO: 184 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 185 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable DVD2030L | AB388VL | AB387VL | SEQ ID NO: 186 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKRGGSGGGGS GQSGLTQPPSASGTPGQRVTISCSGSSSN IGSNTVNWYQQLPGTAPKLLIYSNNQRPS GVPDRFSGSKSGTSASLAISGLQSEDEAD YYCAAWDDSLNGSYVFGTGTKVTVLG |
| VL | | | SEQ ID NO: 187 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKR |
| Linker | | | SEQ ID NO: 188 | GGSGGGGSG |
| VL | | | SEQ ID NO: 189 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 190 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2031H | AB387VH | AB388VH | SEQ ID NO: 191 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSGGGGSGGGGSQIQLVQSGPELKKPGE TVMISCKASGYTFTNYGMNWVKQAPGKGL KWMGWINTYTGEPTYADDFKGRFAFSLET SASTAYLQINNLKNEDTATYFCARKFLTT VVVTDYAMDYWGQGTSVTVSS |
| VH | | | SEQ ID NO: 192 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 193 | GGGGSGGGGS |
| VH | | | SEQ ID NO: 194 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSS |
| CH | | | SEQ ID NO: 195 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2031L | AB387VL | AB388VL | SEQ ID NO: 196 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGGGSG GGGSGDIQMTQTTSSLSASLGDRVTISCR ASQDISNYLNWYQQKPDGTVKLLIYYTSR LQSGVPSRFSGSGSGTDYSLTISNLEQED IATYFCQQGNTLPPTFGVGTKLELKR |
| VL | | | SEQ ID NO: 197 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 198 | GGSGGGGSG |
| VL | | | SEQ ID NO: 199 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKR |
| CL | | | SEQ ID NO: 200 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2032H | AB388VH | AB387VH | SEQ ID NO: 201 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSSASTKGPEVQLVESGGGLVQPG GSLRLSCTASGFTFDDYALHWVRQAPGKG LEWVSGISWHGDFIDYADSVKGRFTISRD NSKNTLYLQMNGLRVEDMAIYYCAGNNRG YGGLDVWGQGTTVTVSS |
| VH | | | SEQ ID NO: 202 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSS |
| Linker | | | SEQ ID NO: 203 | ASTKGP |
| VH | | | SEQ ID NO: 204 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 205 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 1234567890123456789012345678901234567890 |
|---|---|---|---|---|
| DVD-Binding Protein Light Variable DVD2032L | AB388VL | AB387VL | SEQ ID NO: 206 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 207 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKR |
| Linker | | | SEQ ID NO: 208 | TVAAP |
| VL | | | SEQ ID NO: 209 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 210 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2033H | AB387VH | AB388VH | SEQ ID NO: 211 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPQIQLVQSGPELKKPGETVMI SCKASGYTFTNYGMNWVKQAPGKGLKWMG WINTYTGEPTYADDFKGRFAFSLETSAST AYLQINNLKNEDTATYFCARKFLTTVVVT DYAMDYWGQGTSVTVSS |
| VH | | | SEQ ID NO: 212 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 213 | ASTKGP |
| VH | | | SEQ ID NO: 214 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSS |
| CH | | | SEQ ID NO: 215 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence |
|---|---|---|---|---|
| DVD-Binding Protein Light Variable DVD2033L | AB387VL | AB388VL | SEQ ID NO: 216 | QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPDIQMTQTTSSLSASLGDRVTISCRASQDISNYLNWYQQKPDGTVKLLIYYTSRLQSGVPSRFSGSGSGTDYSLTISNLEQEDIATYFCQQGNTLPPTFGVGTKLELKR |
| VL | | | SEQ ID NO: 217 | QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG |
| Linker | | | SEQ ID NO: 218 | QPKAAP |
| VL | | | SEQ ID NO: 219 | DIQMTQTTSSLSASLGDRVTISCRASQDISNYLNWYQQKPDGTVKLLIYYTSRLQSGVPSRFSGSGSGTDYSLTISNLEQEDIATYFCQQGNTLPPTFGVGTKLELKR |
| CL | | | SEQ ID NO: 220 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| DVD-Binding Protein Heavy Variable DVD2034H | AB388VH | AB387VH | SEQ ID NO: 221 | QIQLVQSGPELKKPGETVMISCKASGYTFTNYGMNWVKQAPGKGLKWMGWINTYTGEPTYADDFKGRFAFSLETSASTAYLQINNLKNEDTATYFCARKFLTTVVVTDYAMDYWGQGTSVTVSSASTKGPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS |
| VH | | | SEQ ID NO: 222 | QIQLVQSGPELKKPGETVMISCKASGYTFTNYGMNWVKQAPGKGLKWMGWINTYTGEPTYADDFKGRFAFSLETSASTAYLQINNLKNEDTATYFCARKFLTTVVVTDYAMDYWGQGTSVTVSS |
| Linker | | | SEQ ID NO: 223 | ASTKGP |
| VH | | | SEQ ID NO: 224 | EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS |
| CH | | | SEQ ID NO: 225 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable DVD2034L | AB388VL | AB387VL | SEQ ID NO: 226 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKRTVAAPSVF IFPPQSGLTQPPSASGTPGQRVTISCSGS SSNIGSNTVNWYQQLPGTAPKLLIYSNNQ RPSGVPDRFSGSKSGTSASLAISGLQSED EADYYCAAWDDSLNGSYVFGTGTKVTVLG |
| VL | | | SEQ ID NO: 227 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKR |
| Linker | | | SEQ ID NO: 228 | TVAAPSVFIFPP |
| VL | | | SEQ ID NO: 229 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 230 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2035H | AB387VH | AB388VH | SEQ ID NO: 231 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPQIQLVQSGPELKKPGETVMI SCKASGYTFTNYGMNWVKQAPGKGLKWMG WINTYTGEPTYADDFKGRFAFSLETSAST AYLQINNLKNEDTATYFCARKFLTTVVVT DYAMDYWGQGTSVTVSS |
| VH | | | SEQ ID NO: 232 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 233 | ASTKGP |
| VH | | | SEQ ID NO: 234 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSS |
| CH | | | SEQ ID NO: 235 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable DVD2035L | AB387VL | AB388VL | SEQ ID NO: 236 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APSVTLFPPDIQMTQTTSSLSASLGDRVT ISCRASQDISNYLNWYQQKPDGTVKLLIY YTSRLQSGVPSRFSGSGSGTDYSLTISNL EQEDIATYFCQQGNTLPPTFGVTKLELK R |
| VL | | | SEQ ID NO: 237 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 238 | QPKAAPSVTLFPP |
| VL | | | SEQ ID NO: 239 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKR |
| CL | | | SEQ ID NO: 240 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2036H | AB388VH | AB387VH | SEQ ID NO: 241 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSSASTKGPSVFPLAPEVQLVESG GGLVQPGGSLRLSCTASGFTFDDYALHWV RQAPGKGLEWVSGISWHGDFIDYADSVKG RFTISRDNSKNTLYLQMNGLRVEDMAIYY CAGNNRGYGGLDVWGQGTTVTVSS |
| VH | | | SEQ ID NO: 242 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSS |
| Linker | | | SEQ ID NO: 243 | ASTKGPSVFPLAP |
| VH | | | SEQ ID NO: 244 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 245 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2036L | AB388VL | AB387VL | SEQ ID NO: 246 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 247 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKR |
| Linker | | | SEQ ID NO: 248 | TVAAP |
| VL | | | SEQ ID NO: 249 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 250 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2037H | AB387VH | AB388VH | SEQ ID NO: 251 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPSVFPLAPQIQLVQSGPELKK PGETVMISCKASGYTFTNYGMNWVKQAPG KGLKWMGWINTYTGEPTYADDFKGRFAFS LETSASTAYLQINNLKNEDTATYFCARKF LTTVVVTDYAMDYWGQGTSVTVSS |
| VH | | | SEQ ID NO: 252 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 253 | ASTKGPSVFPLAP |
| VH | | | SEQ ID NO: 254 | QIQLVQSGPELKKPGETVMISCKASGYTF TNYGMNWVKQAPGKGLKWMGWINTYTGEP TYADDFKGRFAFSLETSASTAYLQINNLK NEDTATYFCARKFLTTVVVTDYAMDYWGQ GTSVTVSS |
| CH | | | SEQ ID NO: 255 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2037L | AB387VL | AB388VL | SEQ ID NO: 256 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQTTSSLSASLGDRVTISCRASQ DISNYLNWYQQKPDGTVKLLIYYTSRLQS GVPSRFSGSGSGTDYSLTISNLEQEDIAT YFCQQGNTLPPTFGVGTKLELKR |
| VL | | | SEQ ID NO: 257 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 258 | QPKAAP |
| VL | | | SEQ ID NO: 259 | DIQMTQTTSSLSASLGDRVTISCRASQDI SNYLNWYQQKPDGTVKLLIYYTSRLQSGV PSRFSGSGSGTDYSLTISNLEQEDIATYF CQQGNTLPPTFGVGTKLELKR |
| CL | | | SEQ ID NO: 260 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2038H | AB213VH | AB387VH | SEQ ID NO: 261 | QVQLKESGPGLVAPSQSLSITCTVSGFSL TDYGVNWVRQPPGKGLEWLGMIWGDGSTD YDSTLKSRLSISKDNSKSQIFLKMNSLQT DDTARYYCAREWHHGPVAYWGQGTLVTVS AGGGGSGGGGSEVQLVESGGGLVQPGGSL RLSCTASGFTFDDYALHWVRQAPGKGLEW VSGISWHGDFIDYADSVKGRFTISRDNSK NTLYLQMNGLRVEDMAIYYCAGNNRGYGG LDVWGQGTTVTVSS |
| VH | | | SEQ ID NO: 262 | QVQLKESGPGLVAPSQSLSITCTVSGFSL TDYGVNWVRQPPGKGLEWLGMIWGDGSTD YDSTLKSRLSISKDNSKSQIFLKMNSLQT DDTARYYCAREWHHGPVAYWGQGTLVTVS A |
| Linker | | | SEQ ID NO: 263 | GGGGSGGGGS |
| VH | | | SEQ ID NO: 264 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 265 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2038L | AB213VL | AB387VL | SEQ ID NO: 266 | DIVMTQSHKFMSTTVGDRVSITCKASQAV SSAVAWYQQKPGQSPKLLIYWASTRHTGV PDRFTGSGSVTDFTLTIHNLQAEDLALYY CQQHYSTPFTFGSGTKLEIKRGGSGGGGS GQSGLTQPPSASGTPGQRVTISCSGSSSN IGSNTVNWYQQLPGTAPKLLIYSNNQRPS GVPDRFSGSKSGTSASLAISGLQSEDEAD YYCAAWDDSLNGSYVFGTGTKVTVLG |
| VL | | | SEQ ID NO: 267 | DIVMTQSHKFMSTTVGDRVSITCKASQAV SSAVAWYQQKPGQSPKLLIYWASTRHTGV PDRFTGSGSVTDFTLTIHNLQAEDLALYY CQQHYSTPFTFGSGTKLEIKR |
| Linker | | | SEQ ID NO: 268 | GGSGGGGSG |
| VL | | | SEQ ID NO: 269 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 270 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2039H | AB387VH | AB213VH | SEQ ID NO: 271 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSGGGGSGGGGSQVQLKESGPGLVAPSQ SLSITCTVSGFSLTDYGVNWVRQPPGKGL EWLGMIWGDGSTDYDSTLKSRLSISKDNS KSQIFLKMNSLQTDDTARYYCAREWHHGP VAYWGQGTLVTVSA |
| VH | | | SEQ ID NO: 272 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 273 | GGGGSGGGGS |
| VH | | | SEQ ID NO: 274 | QVQLKESGPGLVAPSQSLSITCTVSGFSL TDYGVNWVRQPPGKGLEWLGMIWGDGSTD YDSTLKSRLSISKDNSKSQIFLKMNSLQT DDTARYYCAREWHHGPVAYWGQGTLVTVS A |
| CH | | | SEQ ID NO: 275 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2039L | AB387VL | AB213VL | SEQ ID NO: 276 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGGGSG GGGSGDIVMTQSHKFMSTTVGDRVSITCK ASQAVSSAVAWYQQKPGQSPKLLIYWAST RHTGVPDRFTGSGSVTDFTLTIHNLQAED LALYYCQQHYSTPFTFGSGTKLEIKR |
| VL | | | SEQ ID NO: 277 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 278 | GGSGGGGSG |
| VL | | | SEQ ID NO: 279 | DIVMTQSHKFMSTTVGDRVSITCKASQAV SSAVAWYQQKPGQSPKLLIYWASTRHTGV PDRFTGSGSVTDFTLTIHNLQAEDLALYY CQQHYSTPFTFGSGTKLEIKR |
| CL | | | SEQ ID NO: 280 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2040H | AB213VH | AB387VH | SEQ ID NO: 281 | QVQLKESGPGLVAPSQSLSITCTVSGFSL TDYGVNWVRQPPGKGLEWLGMIWGDGSTD YDSTLKSRLSISKDNSKSQIFLKMNSLQT DDTARYYCAREWHHGPVAYWGQGTLVTVS AASTKGPEVQLVESGGGLVQPGGSLRLSC TASGFTFDDYALHWVRQAPGKGLEWVSGI SWHGDFIDYADSVKGRFTISRDNSKNTLY LQMNGLRVEDMAIYYCAGNNRGYGGLDVW GQGTTVTVSS |
| VH | | | SEQ ID NO: 282 | QVQLKESGPGLVAPSQSLSITCTVSGFSL TDYGVNWVRQPPGKGLEWLGMIWGDGSTD YDSTLKSRLSISKDNSKSQIFLKMNSLQT DDTARYYCAREWHHGPVAYWGQGTLVTVS A |
| Linker | | | SEQ ID NO: 283 | ASTKGP |
| VH | | | SEQ ID NO: 284 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 285 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable DVD2040L | AB213VL | AB387VL | SEQ ID NO: 286 | DIVMTQSHKFMSTTVGDRVSITCKASQAV SSAVAWYQQKPGQSPKLLIYWASTRHTGV PDRFTGSGSVTDFTLTIHNLQAEDLALYY CQQHYSTPFTFGSGTKLEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 287 | DIVMTQSHKFMSTTVGDRVSITCKASQAV SSAVAWYQQKPGQSPKLLIYWASTRHTGV PDRFTGSGSVTDFTLTIHNLQAEDLALYY CQQHYSTPFTFGSGTKLEIKR |
| Linker | | | SEQ ID NO: 288 | TVAAP |
| VL | | | SEQ ID NO: 289 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 290 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2041H | AB387VH | AB213VH | SEQ ID NO: 291 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPQVQLKESGPGLVAPSQSLSI TCTVSGFSLTDYGVNWVRQPPGKGLEWLG MIWGDGSTDYDSTLKSRLSISKDNSKSQI FLKMNSLQTDDTARYYCAREWHHGPVAYW GQGTLVTVSA |
| VH | | | SEQ ID NO: 292 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 293 | ASTKGP |
| VH | | | SEQ ID NO: 294 | QVQLKESGPGLVAPSQSLSITCTVSGFSL TDYGVNWVRQPPGKGLEWLGMIWGDGSTD YDSTLKSRLSISKDNSKSQIFLKMNSLQT DDTARYYCAREWHHGPVAYWGQGTLVTVS A |
| CH | | | SEQ ID NO: 295 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456 7890 |
|---|---|---|---|---|
| DVD-Binding Protein Light Variable DVD2041L | AB387VL | AB213VL | SEQ ID NO: 296 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIVMTQSHKFMSTTVGDRVSITCKASQ AVSSAVAWYQQKPGQSPKLLIYWASTRHT GVPDRFTGSGSVTDFTLTIHNLQAEDLAL YYCQQHYSTPFTFGSGTKLEIKR |
| VL | | | SEQ ID NO: 297 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 298 | QPKAAP |
| VL | | | SEQ ID NO: 299 | DIVMTQSHKFMSTTVGDRVSITCKASQAV SSAVAWYQQKPGQSPKLLIYWASTRHTGV PDRFTGSGSVTDFTLTIHNLQAEDLALYY CQQHYSTPFTFGSGTKLEIKR |
| CL | | | SEQ ID NO: 300 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2042H | AB390VH | AB387VH | SEQ ID NO: 301 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSGGGGSGGGGSEVQLVESGGGLVQP GGSLRLSCTASGFTFDDYALHWVRQAPGK GLEWVSGISWHGDFIDYADSVKGRFTISR DNSKNTLYLQMNGLRVEDMAIYYCAGNNR GYGGLDVWGQGTTVTVSS |
| VH | | | SEQ ID NO: 302 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 303 | GGGGSGGGGS |
| VH | | | SEQ ID NO: 304 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 305 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence |
|---|---|---|---|---|
| DVD-Binding Protein Light Variable DVD2042L | AB390VL | AB387VL | SEQ ID NO: 306 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKRGGSGGGGS GQSGLTQPPSASGTPGQRVTISCSGSSSN IGSNTVNWYQQLPGTAPKLLIYSNNQRPS GVPDRFSGSKSGTSASLAISGLQSEDEAD YYCAAWDDSLNGSYVFGTGTKVTVLG |
| VL | | | SEQ ID NO: 307 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 308 | GGSGGGGSG |
| VL | | | SEQ ID NO: 309 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 310 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2043H | AB387VH | AB390VH | SEQ ID NO: 311 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSGGGGSGGGGSEVQLVESGGGLVQPGR SLRLSCAASGFTFDDYAMHWVRQAPGKGL EWVSAITWNSGHIDYADSVEGRFTISRDN AKNSLYLQMNSLRAEDTAVYYCAKVSYLS TASSLDYWGQGTLVTVSS |
| VH | | | SEQ ID NO: 312 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 313 | GGGGSGGGGS |
| VH | | | SEQ ID NO: 314 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 315 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2043L | AB387VL | AB390VL | SEQ ID NO: 316 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGGSG GGGSGDIQMTQSPSSLSASVGDRVTITCR ASGGIRNYLGWYQQKPGKAPKLLIYAAST LQSGVPSRFSGSGSGTDFTLTISSLQPED VATYYCQRYNRAPYTFGQGTKVEIKR |
| VL | | | SEQ ID NO: 317 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 318 | GGSGGGGSG |
| VL | | | SEQ ID NO: 319 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKR |
| CL | | | SEQ ID NO: 320 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2044H | AB390VH | AB387VH | SEQ ID NO: 321 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPEVQLVESGGGLVQPGGSL RLSCTASGFTFDDYALHWVRQAPGKGLEW VSGISWHGDFIDYADSVKGRFTISRDNSK NTLYLQMNGLRVEDMAIYYCAGNNRGYGG LDVWGQGTTVTVSS |
| VH | | | SEQ ID NO: 322 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 323 | ASTKGP |
| VH | | | SEQ ID NO: 324 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 325 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2044L | AB390VL | AB387VL | SEQ ID NO: 326 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 327 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 328 | TVAAP |
| VL | | | SEQ ID NO: 329 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 330 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2045H | AB387VH | AB390VH | SEQ ID NO: 331 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEVQLVESGGGLVQPGRSLRL SCAASGFTFDDYAMHWVRQAPGKGLEWVS AITWNSGHIDYADSVEGRFTISRDNAKNS LYLQMNSLRAEDTAVYYCAKVSYLSTASS LDYWGQGTLVTVSS |
| VH | | | SEQ ID NO: 332 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 333 | ASTKGP |
| VH | | | SEQ ID NO: 334 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 335 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2045L | AB387VL | AB390VL | SEQ ID NO: 336 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASG GIRNYLGWYQQKPGKAPKLLIYAASTLQS GVPSRFSGSGSGTDFTLTISSLQPEDVAT YYCQRYNRAPYTFGQGTKVEIKR |
| VL | | | SEQ ID NO: 337 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 338 | QPKAAP |
| VL | | | SEQ ID NO: 339 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKR |
| CL | | | SEQ ID NO: 340 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2046H | AB390VH | AB387VH | SEQ ID NO: 341 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPEVQLVESGGGLVQPGGSL RLSCTASGFTFDDYALHWVRQAPGKGLEW VSGISWHGDFIDYADSVKGRFTISRDNSK NTLYLQMNGLRVEDMAIYYCAGNNRGYGG LDVWGQGTTVTSS |
| VH | | | SEQ ID NO: 342 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 343 | ASTKGP |
| VH | | | SEQ ID NO: 344 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 345 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 1234567890123456789012345678901234567890 |
|---|---|---|---|---|
| DVD-Binding Protein Light Variable DVD2046L | AB390VL | AB387VL | SEQ ID NO: 346 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKRTVAAPSVF IFPPQSGLTQPPSASGTPGQRVTISCSGS SSNIGSNTVNWYQQLPGTAPKLLIYSNNQ RPSGVPDRFSGSKSGTSASLAISGLQSED EADYYCAAWDDSLNGSYVFGTGTKVTVLG |
| VL | | | SEQ ID NO: 347 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 348 | TVAAPSVFIFPP |
| VL | | | SEQ ID NO: 349 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 350 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2047H | AB387VH | AB390VH | SEQ ID NO: 351 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEVQLVESGGGLVQPGRSLRL SCAASGFTFDDYAMHWVRQAPGKGLEWVS AITWNSGHIDYADSVEGRFTISRDNAKNS LYLQMNSLRAEDTAVYYCAKVSYLSTASS LDYWGQGTLVTVSS |
| VH | | | SEQ ID NO: 352 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 353 | ASTKGP |
| VH | | | SEQ ID NO: 354 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 355 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2047L | AB387VL | AB390VL | SEQ ID NO: 356 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APSVTLFPPDIQMTQSPSSLSASVGDRVT ITCRASGGIRNYLGWYQQKPGKAPKLLIY AASTLQSGVPSRFSGSGSGTDFTLTISSL QPEDVATYYCQRYNRAPYTFGQGTKVEIK R |
| VL | | | SEQ ID NO: 357 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 358 | QPKAAPSVTLFPP |
| VL | | | SEQ ID NO: 359 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKR |
| CL | | | SEQ ID NO: 360 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2048H | AB390VH | AB387VH | SEQ ID NO: 361 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPSVFPLAPEVQLVESGGGL VQPGGSLRLSCTASGFTFDDYALHWVRQA PGKGLEWVSGISWHGDFIDYADSVKGRFT ISRDNSKNTLYLQMNGLRVEDMAIYYCAG NNRGYGGLDVWGQGTTVTVSS |
| VH | | | SEQ ID NO: 362 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 363 | ASTKGPSVFPLAP |
| VH | | | SEQ ID NO: 364 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 365 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2048L | AB390VL | AB387VL | SEQ ID NO: 366 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 367 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 368 | TVAAP |
| VL | | | SEQ ID NO: 369 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 370 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2049H | AB387VH | AB390VH | SEQ ID NO: 371 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPSVFPLAPEVQLVESGGGLVQ PGRSLRLSCAASGFTFDDYAMHWVRQAPG KGLEWVSAITWNSGHIDYADSVEGRFTIS RDNAKNSLYLQMNSLRAEDTAVYYCAKVS YLSTASSLDYWGQGTLVTVSS |
| VH | | | SEQ ID NO: 372 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 373 | ASTKGPSVFPLAP |
| VH | | | SEQ ID NO: 374 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 375 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2049L | AB387VL | AB390VL | SEQ ID NO: 376 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASG GIRNYLGWYQQKPGKAPKLLIYAASTLQS GVPSRFSGSGSGTDFTLTISSLQPEDVAT YYCQRYNRAPYTFGQGTKVEIKR |
| VL | | | SEQ ID NO: 377 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 378 | QPKAAP |
| VL | | | SEQ ID NO: 379 | DIQMTQSPSSLSASVGDRVTITCRASGGI RNYLGWYQQKPGKAPKLLIYAASTLQSGV PSRFSGSGSGTDFTLTISSLQPEDVATYY CQRYNRAPYTFGQGTKVEIKR |
| CL | | | SEQ ID NO: 380 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2050H | AB391VH | AB387VH | SEQ ID NO: 381 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSGGGGSGGGGSEVQLVESGGGLVQP GGSLRLSCTASGFTFDDYALHWVRQAPGK GLEWVSGISWHGDFIDYADSVKGRFTISR DNSKNTLYLQMNGLRVEDMAIYYCAGNNR GYGGLDVWGQGTTVTVSS |
| VH | | | SEQ ID NO: 382 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 383 | GGGGSGGGGS |
| VH | | | SEQ ID NO: 384 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 385 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456 7890 |
|---|---|---|---|---|
| DVD-Binding Protein Light Variable DVD2050L | AB391VL | AB387VL | SEQ ID NO: 386 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKRGGSGGGGS GQSGLTQPPSASGTPGQRVTISCSGSSSN IGSNTVNWYQQLPGTAPKLLIYSNNQRPS GVPDRFSGSKSGTSASLAISGLQSEDEAD YYCAAWDDSLNGSYVFGTGTKVTVLG |
| VL | | | SEQ ID NO: 387 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 388 | GGSGGGGSG |
| VL | | | SEQ ID NO: 389 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 390 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2051H | AB387VH | AB391VH | SEQ ID NO: 391 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSGGGGSGGGGSEVQLVESGGGLVQPGR SLRLSCAASGFTFDDYAMHWVRQAPGKGL EWVSAITWNSGHIDYADSVEGRFTISRDN AKNSLYLQMNSLRAEDTAVYYCAKVSYLS TASSLDYWGQGTLVTVSS |
| VH | | | SEQ ID NO: 392 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 393 | GGGGSGGGGS |
| VH | | | SEQ ID NO: 394 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 395 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2051L | AB387VL | AB391VL | SEQ ID NO: 396 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGGSG GGGSGDIQMTQSPSSLSASVGDRVTITCR ASQSIRNYLSWYQQKPGKAPKLLIYAAST LQSGVPSRFSGSGSGTDFTLTISSLQPED VATYYCQRYNRAPYTFGQGTKVEIKR |
| VL | | | SEQ ID NO: 397 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 398 | GGSGGGGSG |
| VL | | | SEQ ID NO: 399 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 400 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2052H | AB391VH | AB387VH | SEQ ID NO: 401 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPEVQLVESGGGLVQPGGSL RLSCTASGFTFDDYALHWVRQAPGKGLEW VSGISWHGDFIDYADSVKGRFTISRDNSK NTLYLQMNGLRVEDMAIYYCAGNNRGYGG LDVWGQGTTVTVSS |
| VH | | | SEQ ID NO: 402 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 403 | ASTKGP |
| VH | | | SEQ ID NO: 404 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 405 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable DVD2052L | AB391VL | AB387VL | SEQ ID NO: 406 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 407 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 408 | TVAAP |
| VL | | | SEQ ID NO: 409 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 410 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2053H | AB387VH | AB391VH | SEQ ID NO: 411 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEVQLVESGGGLVQPGRSLRL SCAASGFTFDDYAMHWVRQAPGKGLEWVS AITWNSGHIDYADSVEGRFTISRDNAKNS LYLQMNSLRAEDTAVYYCAKVSYLSTASS LDYWGQGTLVTVSS |
| VH | | | SEQ ID NO: 412 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 413 | ASTKGP |
| VH | | | SEQ ID NO: 414 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 415 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2053L | AB387VL | AB391VL | SEQ ID NO: 416 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASQ SIRNYLSWYQQKPGKAPKLLIYAASTLQS GVPSRFSGSGSGTDFTLTISSLQPEDVAT YYCQRYNRAPYTFGQGTKVEIKR |
| VL | | | SEQ ID NO: 417 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 418 | QPKAAP |
| VL | | | SEQ ID NO: 419 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 420 | |
| DVD-Binding Protein Heavy Variable DVD2054H | AB391VH | AB387VH | SEQ ID NO: 421 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPEVQLVESGGGLVQPGGSL RLSCTASGFTFDDYALHWVRQAPGKGLEW VSGISWHGDFIDYADSVKGRFTISRDNSK NTLYLQMNGLRVEDMAIYYCAGNNRGYGG LDVWGQGTTVTVSS |
| VH | | | SEQ ID NO: 422 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 423 | ASTKGP |
| VH | | | SEQ ID NO: 424 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 425 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2054L | AB391VL | AB387VL | SEQ ID NO: 426 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKRTVAAPSVF IFPPQSGLTQPPSASGTPGQRVTISCSGS SSNIGSNTVNWYQQLPGTAPKLLIYSNNQ RPSGVPDRFSGSKSGTSASLAISGLQSED EADYYCAAWDDSLNGSYVFGTGTKVTVLG |
| VL | | | SEQ ID NO: 427 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 428 | TVAAPSVFIFPP |
| VL | | | SEQ ID NO: 429 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 430 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2055H | AB387VH | AB391VH | SEQ ID NO: 431 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEVQLVESGGGLVQPGRSLRL SCAASGFTFDDYAMHWVRQAPGKGLEWVS AITWNSGHIDYADSVEGRFTISRDNAKNS LYLQMNSLRAEDTAVYYCAKVSYLSTASS LDYWGQGTLVTVSS |
| VH | | | SEQ ID NO: 432 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 433 | ASTKGP |
| VH | | | SEQ ID NO: 434 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 435 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD-Binding Protein Light Variable DVD2055L | AB387VL | AB391VL | SEQ ID NO: 436 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APSVTLFPPDIQMTQSPSSLSASVGDRVT ITCRASQSIRNYLSWYQQKPGKAPKLLIY AASTLQSGVPSRFSGSGSGTDFTLTISSL QPEDVATYYCQRYNRAPYTFGQGTKVEIK R |
| VL | | | SEQ ID NO: 437 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 438 | QPKAAPSVTLFPP |
| VL | | | SEQ ID NO: 439 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 440 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2056H | AB391VH | AB387VH | SEQ ID NO: 441 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPSVFPLAPEVQLVESGGGL VQPGGSLRLSCTASGFTFDDYALHWVRQA PGKGLEWVSGISWHGDFIDYADSVKGRFT ISRDNSKNTLYLQMNGLRVEDMAIYYCAG NNRGYGGLDVWGQGTTVTVSS |
| VH | | | SEQ ID NO: 442 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 443 | ASTKGPSVFPLAP |
| VH | | | SEQ ID NO: 444 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 445 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD-Binding Protein Light Variable DVD2056L | AB391VL | AB387VL | SEQ ID NO: 446 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 447 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 448 | TVAAP |
| VL | | | SEQ ID NO: 449 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 450 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2057H | AB387VH | AB391VH | SEQ ID NO: 451 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPSVFPLAPEVQLVESGGGLVQ PGRSLRLSCAASGFTFDDYAMHWVRQAPG KGLEWVSAITWNSGHIDYADSVEGRFTIS RDNAKNSLYLQMNSLRAEDTAVYYCAKVS YLSTASSLDYWGQGTLVTVSS |
| VH | | | SEQ ID NO: 452 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 453 | ASTKGPSVFPLAP |
| VH | | | SEQ ID NO: 454 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 455 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2057L | AB387VL | AB391VL | SEQ ID NO: 456 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASQ SIRNYLSWYQQKPGKAPKLLIYAASTLQS GVPSRFSGSGSGTDFTLTISSLQPEDVAT YYCQRYNRAPYTFGQGTKVEIKR |
| VL | | | SEQ ID NO: 457 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 458 | QPKAAP |
| VL | | | SEQ ID NO: 459 | DIQMTQSPSSLSASVGDRVTITCRASQSI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 460 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2058H | AB392VH | AB387VH | SEQ ID NO: 461 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSGGGGSGGGGSEVQLVESGGGLVQP GGSLRLSCTASGFTFDDYALHWVRQAPGK GLEWVSGISWHGDFIDYADSVKGRFTISR DNSKNTLYLQMNGLRVEDMAIYYCAGNNR GYGGLDVWGQGTTVTVSS |
| VH | | | SEQ ID NO: 462 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 463 | GGGGSGGGGS |
| VH | | | SEQ ID NO: 464 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 465 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2058L | AB392VL | AB387VL | SEQ ID NO: 466 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKRGGSGGGGS GQSGLTQPPSASGTPGQRVTISCSGSSSN IGSNTVNWYQQLPGTAPKLLIYSNNQRPS GVPDRFSGSKSGTSASLAISGLQSEDEAD YYCAAWDDSLNGSYVFGTGTKVTVLG |
| VL | | | SEQ ID NO: 467 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 468 | GGSGGGGSG |
| VL | | | SEQ ID NO: 469 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 470 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2059H | AB387VH | AB392VH | SEQ ID NO: 471 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSGGGGSGGGGSEVQLVESGGGLVQPGR SLRLSCAASGFTFDDYAMHWVRQAPGKGL EWVSAITWNSGHIDYADSVEGRFTISRDN AKNSLYLQMNSLRAEDTAVYYCAKVSYLS TASSLDYWGQGTLVTVSS |
| VH | | | SEQ ID NO: 472 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 473 | GGGGSGGGGS |
| VH | | | SEQ ID NO: 474 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 475 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2059L | AB387VL | AB392VL | SEQ ID NO: 476 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGGSG GGGSGDIQMTQSPSSLSASVGDRVTITCR ASRGIRNYLSWYQQKPGKAPKLLIYAAST LQSGVPSRFSGSGSGTDFTLTISSLQPED VATYYCQRYNRAPYTFGQGTKVEIKR |
| VL | | | SEQ ID NO: 477 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 478 | GGSGGGGSG |
| VL | | | SEQ ID NO: 479 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 480 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2060H | AB392VH | AB387VH | SEQ ID NO: 481 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPEVQLVESGGGLVQPGGSL RLSCTASGFTFDDYALHWVRQAPGKGLEW VSGISWHGDFIDYADSVKGRFTISRDNSK NTLYLQMNGLRVEDMAIYYCAGNNRGYGG LDVWGQGTTVTSS |
| VH | | | SEQ ID NO: 482 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 483 | ASTKGP |
| VH | | | SEQ ID NO: 484 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 485 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2060L | AB392VL | AB387VL | SEQ ID NO: 486 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 487 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 488 | TVAAP |
| VL | | | SEQ ID NO: 489 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 490 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2061H | AB387VH | AB392VH | SEQ ID NO: 491 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEVQLVESGGGLVQPGRSLRL SCAASGFTFDDYAMHWVRQAPGKGLEWVS AITWNSGHIDYADSVEGRFTISRDNAKNS LYLQMNSLRAEDTAVYYCAKVSYLSTASS LDYWGQGTLVTVSS |
| VH | | | SEQ ID NO: 492 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 493 | ASTKGP |
| VH | | | SEQ ID NO: 494 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 495 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable DVD2061L | AB387VL | AB392VL | SEQ ID NO: 496 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASR GIRNYLSWYQQKPGKAPKLLIYAASTLQS GVPSRFSGSGSGTDFTLTISSLQPEDVAT YYCQRYNRAPYTFGQGTKVEIKR |
| VL | | | SEQ ID NO: 497 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 498 | QPKAAP |
| VL | | | SEQ ID NO: 499 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 500 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2062H | AB392VH | AB387VH | SEQ ID NO: 501 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPEVQLVESGGGLVQPGGSL RLSCTASGFTFDDYALHWVRQAPGKGLEW VSGISWHGDFIDYADSVKGRFTISRDNSK NTLYLQMNGLRVEDMAIYYCAGNNRGYGG LDVWGQGTTVTVSS |
| VH | | | SEQ ID NO: 502 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 503 | ASTKGP |
| VH | | | SEQ ID NO: 504 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 505 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456 7890 |
|---|---|---|---|---|
| DVD-Binding Protein Light Variable DVD2062L | AB392VL | AB387VL | SEQ ID NO: 506 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKRTVAAPSVF IFPPQSGLTQPPSASGTPGQRVTISCSGS SSNIGSNTVNWYQQLPGTAPKLLIYSNNQ RPSGVPDRFSGSKSGTSASLAISGLQSED EADYYCAAWDDSLNGSYVFGTGTKVTVLG |
| VL | | | SEQ ID NO: 507 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 508 | TVAAPSVFIFPP |
| VL | | | SEQ ID NO: 509 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 510 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2063H | AB387VH | AB392VH | SEQ ID NO: 511 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEVQLVESGGGLVQPGRSLRL SCAASGFTFDDYAMHWVRQAPGKGLEWVS AITWNSGHIDYADSVEGRFTISRDNAKNS LYLQMNSLRAEDTAVYYCAKVSYLSTASS LDYWGQGTLVTVSS |
| VH | | | SEQ ID NO: 512 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 513 | ASTKGP |
| VH | | | SEQ ID NO: 514 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 515 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2063L | AB387VL | AB392VL | SEQ ID NO: 516 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APSVTLFPPDIQMTQSPSSLSASVGDRVT ITCRASRGIRNYLSWYQQKPGKAPKLLIY AASTLQSGVPSRFSGSGSGTDFTLTISSL QPEDVATYYCQRYNRAPYTFGQGTKVEIK R |
| VL | | | SEQ ID NO: 517 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 518 | QPKAAPSVTLFPP |
| VL | | | SEQ ID NO: 519 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 520 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2064H | AB392VH | AB387VH | SEQ ID NO: 521 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPSVFPLAPEVQLVESGGGL VQPGGSLRLSCTASGFTFDDYALHWVRQA PGKGLEWVSGISWHGDFIDYADSVKGRFT ISRDNSKNTLYLQMNGLRVEDMAIYYCAG NNRGYGGLDVWGQGTTVTVSS |
| VH | | | SEQ ID NO: 522 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 523 | ASTKGPSVFPLAP |
| VH | | | SEQ ID NO: 524 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 525 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2064L | AB392VL | AB387VL | SEQ ID NO: 526 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 527 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 528 | TVAAP |
| VL | | | SEQ ID NO: 529 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 530 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2065H | AB387VH | AB392VH | SEQ ID NO: 531 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPSVFPLAPEVQLVESGGGLVQ PGRSLRLSCAASGFTFDDYAMHWVRQAPG KGLEWVSAITWNSGHIDYADSVEGRFTIS RDNAKNSLYLQMNSLRAEDTAVYYCAKVS YLSTASSLDYWGQGTLVTVSS |
| VH | | | SEQ ID NO: 532 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 533 | ASTKGPSVFPLAP |
| VH | | | SEQ ID NO: 534 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 535 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD-Binding Protein Light Variable DVD2065L | AB387VL | AB392VL | SEQ ID NO: 536 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASR GIRNYLSWYQQKPGKAPKLLIYAASTLQS GVPSRFSGSGSGTDFTLTISSLQPEDVAT YYCQRYNRAPYTFGQGTKVEIKR |
| VL | | | SEQ ID NO: 537 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 538 | QPKAAP |
| VL | | | SEQ ID NO: 539 | DIQMTQSPSSLSASVGDRVTITCRASRGI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 540 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2066H | AB393VH | AB387VH | SEQ ID NO: 541 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSGGGGSGGGGSEVQLVESGGGLVQP GGSLRLSCTASGFTFDDYALHWVRQAPGK GLEWVSGISWHGDFIDYADSVKGRFTISR DNSKNTLYLQMNGLRVEDMAIYYCAGNNR GYGGLDVWGQGTTVTVSS |
| VH | | | SEQ ID NO: 542 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 543 | GGGGSGGGGS |
| VH | | | SEQ ID NO: 544 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 545 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD-Binding Protein Light Variable DVD2066L | AB393VL | AB387VL | SEQ ID NO: 546 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKRGGSGGGGS GQSGLTQPPSASGTPGQRVTISCSGSSSN IGSNTVNWYQQLPGTAPKLLIYSNNQRPS GVPDRFSGSKSGTSASLAISGLQSEDEAD YYCAAWDDSLNGSYVFGTGTKVTVLG |
| VL | | | SEQ ID NO: 547 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 548 | GGSGGGGSG |
| VL | | | SEQ ID NO: 549 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 550 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2067H | AB387VH | AB393VH | SEQ ID NO: 551 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSGGGGSGGGGSEVQLVESGGGLVQPGR SLRLSCAASGFTFDDYAMHWVRQAPGKGL EWVSAITWNSGHIDYADSVEGRFTISRDN AKNSLYLQMNSLRAEDTAVYYCAKVSYLS TASSLDYWGQGTLVTVSS |
| VH | | | SEQ ID NO: 552 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 553 | GGGGSGGGGS |
| VH | | | SEQ ID NO: 554 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 555 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence<br>12345678901234567890 |
|---|---|---|---|---|
| DVD-Binding Protein Light Variable DVD2067L | AB387VL | AB393VL | SEQ ID NO: 556 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGGGSG GGGSGDIQMTQSPSSLSASVGDRVTITCR ASHGIRNYLSWYQQKPGKAPKLLIYAAST LQSGVPSRFSGSGSGTDFTLTISSLQPED VATYYCQRYNRAPYTFGQGTKVEIKR |
| VL | | | SEQ ID NO: 557 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 558 | GGSGGGGSG |
| VL | | | SEQ ID NO: 559 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 560 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2068H | AB393VH | AB387VH | SEQ ID NO: 561 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPEVQLVESGGGLVQPGGSL RLSCTASGFTFDDYALHWVRQAPGKGLEW VSGISWHGDFIDYADSVKGRFTISRDNSK NTLYLQMNGLRVEDMAIYYCAGNNRGYGG LDVWGQGTTVTSS |
| VH | | | SEQ ID NO: 562 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 563 | ASTKGP |
| VH | | | SEQ ID NO: 564 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 565 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 123456789012345678901234567890 |
|---|---|---|---|---|
| DVD-Binding Protein Light Variable DVD2068L | AB393VL | AB387VL | SEQ ID NO: 566 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 567 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 568 | TVAAP |
| VL | | | SEQ ID NO: 569 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 570 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2069H | AB387VH | AB393VH | SEQ ID NO: 571 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEVQLVESGGGLVQPGRSLRL SCAASGFTFDDYAMHWVRQAPGKGLEWVS AITWNSGHIDYADSVEGRFTISRDNAKNS LYLQMNSLRAEDTAVYYCAKVSYLSTASS LDYWGQGTLVTVSS |
| VH | | | SEQ ID NO: 572 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 573 | ASTKGP |
| VH | | | SEQ ID NO: 574 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 575 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2069L | AB387VL | AB393VL | SEQ ID NO: 576 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASH GIRNYLSWYQQKPGKAPKLLIYAASTLQS GVPSRFSGSGSGTDFTLTISSLQPEDVAT YYCQRYNRAPYTFGQGTKVEIKR |
| VL | | | SEQ ID NO: 577 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 578 | QPKAAP |
| VL | | | SEQ ID NO: 579 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 580 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2070H | AB393VH | AB387VH | SEQ ID NO: 581 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPEVQLVESGGGLVQPGGSL RLSCTASGFTFDDYALHWVRQAPGKGLEW VSGISWHGDFIDYADSVKGRFTISRDNSK NTLYLQMNGLRVEDMAIYYCAGNNRGYGG LDVWGQGTTVTSS |
| VH | | | SEQ ID NO: 582 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 583 | ASTKGP |
| VH | | | SEQ ID NO: 584 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 585 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD-Binding Protein Light Variable DVD2070L | AB393VL | AB387VL | SEQ ID NO: 586 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKRTVAAPSVF IFPPQSGLTQPPSASGTPGQRVTISCSGS SSNIGSNTVNWYQQLPGTAPKLLIYSNNQ RPSGVPDRFSGSKSGTSASLAISGLQSED EADYYCAAWDDSLNGSYVFGTGTKVTVLG |
| VL | | | SEQ ID NO: 587 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 588 | TVAAPSVFIFPP |
| VL | | | SEQ ID NO: 589 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 590 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2071H | AB387VH | AB393VH | SEQ ID NO: 591 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPEVQLVESGGGLVQPGRSLRL SCAASGFTFDDYAMHWVRQAPGKGLEWVS AITWNSGHIDYADSVEGRFTISRDNAKNS LYLQMNSLRAEDTAVYYCAKVSYLSTASS LDYWGQGTLVTVSS |
| VH | | | SEQ ID NO: 592 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 593 | ASTKGP |
| VH | | | SEQ ID NO: 594 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 595 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2071L | AB387VL | AB393VL | SEQ ID NO: 596 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APSVTLFPPDIQMTQSPSSLSASVGDRVT ITCRASHGIRNYLSWYQQKPGKAPKLLIY AASTLQSGVPSRFSGSGSGTDFTLTISSL QPEDVATYYCQRYNRAPYTFGQGTKVEIK R |
| VL | | | SEQ ID NO: 597 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 598 | QPKAAPSVTLFPP |
| VL | | | SEQ ID NO: 599 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 600 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2072H | AB393VH | AB387VH | SEQ ID NO: 601 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPSVFPLAPEVQLVESGGGL VQPGGSLRLSCTASGFTFDDYALHWVRQA PGKGLEWVSGISWHGDFIDYADSVKGRFT ISRDNSKNTLYLQMNGLRVEDMAIYYCAG NNRGYGGLDVWGQGTTVTVSS |
| VH | | | SEQ ID NO: 602 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 603 | ASTKGPSVFPLAP |
| VH | | | SEQ ID NO: 604 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| CH | | | SEQ ID NO: 605 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2072L | AB393VL | AB387VL | SEQ ID NO: 606 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKRTVAAPQSG LTQPPSASGTPGQRVTISCSGSSSNIGSN TVNWYQQLPGTAPKLLIYSNNQRPSGVPD RFSGSKSGTSASLAISGLQSEDEADYYCA AWDDSLNGSYVFGTGTKVTVLG |
| VL | | | SEQ ID NO: 607 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 608 | TVAAP |
| VL | | | SEQ ID NO: 609 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| CL | | | SEQ ID NO: 610 | QPKAAPSVTLFPPSSEELQANKATLVCLI SDFYPGAVTVAWKADSSPVKAGVETTTPS KQSNNKYAASSYLSLTPEQWKSHRSYSCQ VTHEGSTVEKTVAPTECS |
| DVD-Binding Protein Heavy Variable DVD2073H | AB387VH | AB393VH | SEQ ID NO: 611 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSSASTKGPSVFPLAPEVQLVESGGGLVQ PGRSLRLSCAASGFTFDDYAMHWVRQAPG KGLEWVSAITWNSGHIDYADSVEGRFTIS RDNAKNSLYLQMNSLRAEDTAVYYCAKVS YLSTASSLDYWGQGTLVTVSS |
| VH | | | SEQ ID NO: 612 | EVQLVESGGGLVQPGGSLRLSCTASGFTF DDYALHWVRQAPGKGLEWVSGISWHGDFI DYADSVKGRFTISRDNSKNTLYLQMNGLR VEDMAIYYCAGNNRGYGGLDVWGQGTTVT VSS |
| Linker | | | SEQ ID NO: 613 | ASTKGPSVFPLAP |
| VH | | | SEQ ID NO: 614 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| CH | | | SEQ ID NO: 615 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable DVD2073L | AB387VL | AB393VL | SEQ ID NO: 616 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLGQPKA APDIQMTQSPSSLSASVGDRVTITCRASH GIRNYLSWYQQKPGKAPKLLIYAASTLQS GVPSRFSGSGSGTDFTLTISSLQPEDVAT YYCQRYNRAPYTFGQGTKVEIKR |
| VL | | | SEQ ID NO: 617 | QSGLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGSYVFGTGTKVTVLG |
| Linker | | | SEQ ID NO: 618 | QPKAAP |
| VL | | | SEQ ID NO: 619 | DIQMTQSPSSLSASVGDRVTITCRASHGI RNYLSWYQQKPGKAPKLLIYAASTLQSGV PSRFSGSGSGTDFTLTISSLQPEDVATYY CQRYNRAPYTFGQGTKVEIKR |
| CL | | | SEQ ID NO: 620 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD Binding Protein Heavy Variable DVD2074H | AB017VH | AB235VH | SEQ ID NO: 621 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSGGGGSGGGGSEVQLVQSGAEVKKP GASVKVSCKASGYTFTDYNMHWVRQAPGQ GLEWMGEINPNSGGAGYNQKFKGRVTMTT DTSTSTAYMELRSLRSDDTAVYYCARLGY DDIYDDWYFDVWGQGTTVTVSS |
| VH | | | SEQ ID NO: 622 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 623 | GGGGSGGGGS |
| VH | | | SEQ ID NO: 624 | EVQLVQSGAEVKKPGASVKVSCKASGYTF TDYNMHWVRQAPGQGLEWMGEINPNSGGA GYNQKFKGRVTMTTDTSTSTAYMELRSLR SDDTAVYYCARLGYDDIYDDWYFDVWGQG TTVTVSS |
| CH | | | SEQ ID NO: 625 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable DVD2074L | AB017VL | AB235VL | SEQ ID NO: 626 | DIQMTQSPSSLSASVGDRVTITCRASQGI RNYLAWYQQKPGKAPKLLIYAASTLQSGV PSRFSGSGSGTDFTLTISSLQPEDVATYY CQRYNRAPYTFGQGTKVEIKRGGSGGGGS GDIQMTQSPSSLSASVGDRVTITCRASQD ISNYLNWYQQKPGKAPKLLIYYTSRLLSG VPSRFSGSGSGTDFTLTISSLQPEDFATY YCQQGDTLPYTFGGGTKVEIKR |
| VL | | | SEQ ID NO: 627 | DIQMTQSPSSLSASVGDRVTITCRASQGI RNYLAWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 628 | GGSGGGGSG |
| VL | | | SEQ ID NO: 629 | DIQMTQSPSSLSASVGDRVTITCRASQDI SNYLNWYQQKPGKAPKLLIYYTSRLLSGV PSRFSGSGSGTDFTLTISSLQPEDFATYY CQQGDTLPYTFGGGTKVEIKR |
| CL | | | SEQ ID NO: 630 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable DVD2075H | AB235VH | AB017VH | SEQ ID NO: 631 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSSASTKGPEVQLVQSGAEVKKPGASV KVSCKASGYTFTDYNMHWVRQAPGQGLEW MGEINPNSGGAGYNQKFKGRVTMTTDTST STAYMELRSLRSDDTAVYYCARLGYDDIY DDWYFDVWGQGTTVTVSS |
| VH | | | SEQ ID NO: 632 | EVQLVESGGGLVQPGRSLRLSCAASGFTF DDYAMHWVRQAPGKGLEWVSAITWNSGHI DYADSVEGRFTISRDNAKNSLYLQMNSLR AEDTAVYYCAKVSYLSTASSLDYWGQGTL VTVSS |
| Linker | | | SEQ ID NO: 633 | ASTKGP |
| VH | | | SEQ ID NO: 634 | EVQLVQSGAEVKKPGASVKVSCKASGYTF TDYNMHWVRQAPGQGLEWMGEINPNSGGA GYNQKFKGRVTMTTDTSTSTAYMELRSLR SDDTAVYYCARLGYDDIYDDWYFDVWGQG TTVTVSS |
| CH | | | SEQ ID NO: 635 | ASTKGPSVFPLAPSSKSTSGGTAALGCLV KDYFPEPVTVSWNSGALTSGVHTFPAVLQ SSGLYSLSSVVTVPSSSLGTQTYICNVNH KPSNTKVDKKVEPKSCDKTHTCPPCPAPE AAGGPSVFLFPPKPKDTLMISRTPEVTCV VVDVSHEDPEVKFNWYVDGVEVHNAKTKP REEQYNSTYRVVSVLTVLHQDWLNGKEYK CKVSNKALPAPIEKTISKAKGQPREPQVY TLPPSREEMTKNQVSLTCLVKGFYPSDIA VEWESNGQPENNYKTTPPVLDSDGSFFLY SKLTVDKSRWQQGNVFSCSVMHEALHNHY TQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>123456789012345678901234567890 |
|---|---|---|---|---|
| DVD-Binding Protein Light Variable DVD2075L | AB235VL | AB017VL | SEQ ID NO: 636 | DIQMTQSPSSLSASVGDRVTITCRASQGI RNYLAWYQQKPGKAPKLLIYAASTLQSGV PSRFSGSGSGTDFTLTISSLQPEDVATYY CQRYNRAPYTFGQGTKVEIKRTVAAPDIQ MTQSPSSLSASVGDRVTITCRASQDISNY LNWYQQKPGKAPKLLIYYTSRLLSGVPSR FSGSGSGTDFTLTISSLQPEDFATYYCQQ GDTLPYTFGGGTKVEIKR |
| VL | | | SEQ ID NO: 637 | DIQMTQSPSSLSASVGDRVTITCRASQGI RNYLAWYQQKPGKAPKLLIYAASTLQSGV PSRFSGSGSGTDFTLTISSLQPEDVATYY CQRYNRAPYTFGQGTKVEIKR |
| Linker | | | SEQ ID NO: 638 | TVAAP |
| VL | | | SEQ ID NO: 639 | DIQMTQSPSSLSASVGDRVTITCRASQDI SNYLNWYQQKPGKAPKLLIYYTSRLLSGV PSRFSGSGSGTDFTLTISSLQPEDFATYY CQQGDTLPYTFGGGTKVEIKR |
| CL | | | SEQ ID NO: 640 | TVAAPSVFIFPPSDEQLKSGTASVVCLLN NFYPREAKVQWKVDNALQSGNSQESVTEQ DSKDSTYSLSSTLTLSKADYEKHKVYACE VTHQGLSSPVTKSFNRGEC |
| DVD-Binding Protein Heavy Variable MAK199-1-GS-AE10-6 AM7 | MAK199-1 VH | AE10-6 AM7 VH | SEQ ID NO: 641 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSSGGGGSGGGGSEVQLVQ SGAEVKKPGASVKVSCKVSGYTLTELSM HWVRQAPGKGLEWMGGFDPEDGETIYAQ KFQGRVTMTEDTSTDTAYMELSSLRSED TAVYYCATDTVGYWEKFFQHWGQGTLVT VSS |
| VH | | | SEQ ID NO: 642 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSS |
| Linker | | | SEQ ID NO: 643 | GGGGSGGGGS |
| VH | | | SEQ ID NO: 644 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH | | | SEQ ID NO: 645 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable MAK199-1-GS-AE10-6 AM7 | MAK199-1 VL | AE10-6 AM7 VL | SEQ ID NO: 646 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKRGGSG GGGSGQAVVTQEPSLTVSPGGTVTLTCG SSTGTVTIDHYPYWFQQKPGQAPRTLIS DTDDKHSWTPARFSGSLLGGKAALTLSG AQPEDEAEYYCLLDYGGRFVFGGGTKLT VLG |
| VL | | | SEQ ID NO: 647 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKR |
| Linker | | | SEQ ID NO: 648 | GGSGGGGSG |
| VL | | | SEQ ID NO: 649 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 650 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK199-1-SS-AE10-6 AM7 | MAK199-1 VH | AE10-6 AM7 VH | SEQ ID NO: 651 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSSASTKGPEVQLVQSGAE VKKPGASVKVSCKVSGYTLTELSMHWVR QAPGKGLEWMGGFDPEDGETIYAQKFQG RVTMTEDTSTDTAYMELSSLRSEDTAVY YCATDTVGYWEKFFQHWGQGTLVTVSS |
| VH | | | SEQ ID NO: 652 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSS |
| Linker | | | SEQ ID NO: 653 | ASTKGP |
| VH | | | SEQ ID NO: 654 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH | | | SEQ ID NO: 655 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable MAK199-1-SS-AE10-6 AM7 | MAK199-1 VL | AE10-6 AM7 VL | SEQ ID NO: 656 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKRTVAA PQAVVTQEPSLTVSPGGTVTLTCGSSTG TVTIDHYPYWFQQKPGQAPRTLISDTDD KHSWTPARFSGSLLGGKAALTLSGAQPE DEAEYYCLLDYGGRFVFGGGTKLTVLG |
| VL | | | SEQ ID NO: 657 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKR |
| Linker | | | SEQ ID NO: 658 | TVAAP |
| VL | | | SEQ ID NO: 659 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 660 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK195-21-GS-AE10-6 AM7 | MAK195-21 VH | AE10-6 AM7 VH | SEQ ID NO: 661 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSGGGGSGGGGSEVQLVQSGAEVKK PGASVKVSCKVSGYTLTELSMHWVRQAP GKGLEWMGGFDPEDGETIYAQKFQGRVT MTEDTSTDTAYMELSSLRSEDTAVYYCA TDTVGYWEKFFQHWGQGTLVTVSS |
| VH | | | SEQ ID NO: 662 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 663 | GGGGSGGGGS |
| VH | | | SEQ ID NO: 664 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH | | | SEQ ID NO: 665 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD-Binding Protein Light Variable MAK195-21-GS-AE10-6 AM7 | MAK195-21 VL | AE10-6 AM7 VL | SEQ ID NO: 666 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKGGSGG GGSGQAVVTQEPSLTVSPGGTVTLTCGS STGTVTIDHYPYWFQQKPGQAPRTLISD TDDKHSWTPARFSGSLLGGKAALTLSGA QPEDEAEYYCLLDYGGRFVFGGGTKLTV LG |
| VL | | | SEQ ID NO: 667 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIK |
| Linker | | | SEQ ID NO: 668 | GGSGGGGSG |
| VL | | | SEQ ID NO: 669 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 670 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK195-21-SS-AE10-6AM7 | MAK195-21 VH | AE10-6 AM7 VH | SEQ ID NO: 671 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPEVQLVQSGAEVKKPGAS VKVSCKVSGYTLTELSMHWVRQAPGKGL EWMGGFDPEDGETIYAQKFQGRVTMTED TSTDTAYMELSSLRSEDTAVYYCATDTV GYWEKFFQHWGQGTLVTVSS |
| VH | | | SEQ ID NO: 672 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 673 | ASTKGP |
| VH | | | SEQ ID NO: 674 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH | | | SEQ ID NO: 675 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable MAK195-21-SS-AE10-6 AM7 | MAK195-21 VL | AE10-6 AM7 VL | SEQ ID NO: 676 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PQAVVTQEPSLTVSPGGTVTLTCGSSTG TVTIDHYPYWFQQKPGQAPRTLISDTDD KHSWTPARFSGSLLGGKAALTLSGAQPE DEAEYYCLLDYGGRFVFGGGTKLTVLG |
| VL | | | SEQ ID NO: 677 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Linker | | | SEQ ID NO: 678 | TVAAP |
| VL | | | SEQ ID NO: 679 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 680 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK199-1-GS-AE10-6 AM7 QL | MAK199-1 VH | AE10-6 AM7 VH | SEQ ID NO: 681 | EVQLVQSGAEVKKPGASVKVSCKASGYT FANYGIIWVRQAPGQGLEWMGWINTYTG KPTYAQKFQGRVTMTTDTSTAYMELS SLRSEDTAVYYCARKLFTTMDVTDNAMD YWGQGTTVTVSSGGGGSGGGGSEVQLVQ SGAEVKKPGASVKVSCKVSGYTLTELSM HWVRQAPGKGLEWMGGFDPEDGETIYAQ KFQGRVTMTEDTSTDTAYMELSSLRSED TAVYYCATDTVGYWEKFFQHWGQGTLVT VSS |
| VH | | | SEQ ID NO: 682 | EVQLVQSGAEVKKPGASVKVSCKASGYT FANYGIIWVRQAPGQGLEWMGWINTYTG KPTYAQKFQGRVTMTTDTSTAYMELS SLRSEDTAVYYCARKLFTTMDVTDNAMD YWGQGTTVTVSS |
| Linker | | | SEQ ID NO: 683 | GGGGSGGGGS |
| VH | | | SEQ ID NO: 684 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH QL | | | SEQ ID NO: 685 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDQLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVLHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789O |
|---|---|---|---|---|
| DVD-Binding Protein Light Variable MAK199-1-GS-AE10-6 AM7 QL | MAK199-1 VL | AE10-6 AM7 VL | SEQ ID NO: 686 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKRGGSG GGGSGQAVVTQEPSLTVSPGGTVTLTCG SSTGTVTIDHYPYWFQQKPGQAPRTLIS DTDDKHSWTPARFSGSLLGGKAALTLSG AQPEDEAEYYCLLDYGGRFVFGGGTKLT VLG |
| VL | | | SEQ ID NO: 687 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKR |
| Linker | | | SEQ ID NO: 688 | GGSGGGGSG |
| VL | | | SEQ ID NO: 689 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 690 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK199-1-SS-AE10-6 AM7 QL | MAK199-1 VH | AE10-6 AM7 VH | SEQ ID NO: 691 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSSASTKGPEVQLVQSGAE VKKPGASVKVSCKVSGYTLTELSMHWVR QAPGKGLEWMGGFDPEDGETIYAQKFQG RVTMTEDTSTDTAYMELSSLRSEDTAVY YCATDTVGYWEKFFQHWGQGTLVTVSS |
| VH | | | SEQ ID NO: 692 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSS |
| Linker | | | SEQ ID NO: 693 | ASTKGP |
| VH | | | SEQ ID NO: 694 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH QL | | | SEQ ID NO: 695 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDQLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVLHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890 |
|---|---|---|---|---|
| DVD-Binding Protein Light Variable MAK199-1-SS-AE10-6 AM7 QL | MAK199-1 VL | AE10-6 AM7 VL | SEQ ID NO: 696 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKRTVAA PQAVVTQEPSLTVSPGGTVTLTCGSSTG TVTIDHYPYWFQQKPGQAPRTLISDTDD KHSWTPARFSGSLLGGKAALTLSGAQPE DEAEYYCLLDYGGRFVFGGGTKLTVLG |
| VL | | | SEQ ID NO: 697 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKR |
| Linker | | | SEQ ID NO: 698 | TVAAP |
| VL | | | SEQ ID NO: 699 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 700 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK195-1-GS-AE10-6 AM3 | MAK195-21 VH | AE10-6 AM3 VH | SEQ ID NO: 701 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSGGGGSGGGGSEVQLVQSGAEVKK PGASVKVSCKVSGYTLTELSMHWVRQAP GKGLEWMGGFDPEDGETIYAQKFQGRVT MTEDTSTDTAYMELSSLRSEDTAVYYCA TDSAGYWYKFFQHWGQGTLVTVSS |
| VH | | | SEQ ID NO: 702 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 703 | GGGGSGGGGS |
| VH | | | SEQ ID NO: 704 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDSAGYWYKFFQHWG QGTLVTVSS |
| CH | | | SEQ ID NO: 705 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 123456789012345678901234567890 |
|---|---|---|---|---|
| DVD-Binding Protein Light Variable MAK195-21-GS-AE10-6 AM3 | MAK195-21 VL | AE10-6 AM3 VL | SEQ ID NO: 706 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKGGSGG GGSGQAVVTQEPSLTVSPGGTVTLTCGS STGAVTIDHYPYWFQQKPGQAPRTLISD TDDKHSWTPARFSGSLLGGKAALTLSGA QPEDEAEYYCLLDYGGTFVFGGGTKLTV LG |
| VL | | | SEQ ID NO: 707 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIK |
| Linker | | | SEQ ID NO: 708 | GGSGGGGSG |
| VL | | | SEQ ID NO: 709 | QAVVTQEPSLTVSPGGTVTLTCGSSTGA VTIDHYPYWFQQKPGQAPRTLISDTDDK HSWTPARFSGSLLGGKAALTLSGAQPED EAEYYCLLDYGGTFVFGGGTKLTVLG |
| CL | | | SEQ ID NO: 710 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable AE10-6 AM7-GS-MAK195-21 | AE10-6 AM7 VH | MAK195-21 VH | SEQ ID NO: 711 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSSGGGGSGGGGSEVQLVESGG GLVQPGGSLRLSCAASGFTFSNYGVTWV RQAPGKGLEWVSMIWADGSTHYASSVKG RFTISRDNSKNTLYLQMNSLRAEDTAVY YCAREWQHGPVAYWGQGTLVTVSS |
| VH | | | SEQ ID NO: 712 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| Linker | | | SEQ ID NO: 713 | GGGGSGGGGS |
| VH | | | SEQ ID NO: 714 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| CH | | | SEQ ID NO: 715 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123 4567890 |
|---|---|---|---|---|
| DVD-Binding Protein Light Variable AE10-6 AM7-GS-MAK195-21 | AE10-6 AM7 VL | MAK195/21 VL | SEQ ID NO: 716 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLGGG SGGGGSGDIQMTQSPSSLSASVGDRVTI TCRASQLVSSAVAWYQQKPGKAPKLLIY WASARHTGVPSRFSGSGSGTDFTLTISS LQPEDFATYYCQQHYKTPFTFGQGTKLE IKR |
| VL | | | SEQ ID NO: 717 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| Linker | | | SEQ ID NO: 718 | GGSGGGGSG |
| VL | | | SEQ ID NO: 719 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Ck | | | SEQ ID NO: 720 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD-Binding Protein Heavy Variable MAK199-1-GS-AE10-6 AM7 wtQL | MAK199-1 VH | AE10-6 AM7 VH | SEQ ID NO: 721 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSSGGGGSGGGGSEVQLVQ SGAEVKKPGASVKVSCKVSGYTLTELSM HWVRQAPGKGLEWMGGFDPEDGETIYAQ KFQGRVTMTEDTSTDTAYMELSSLRSED TAVYYCATDTVGYWEKFFQHWGQGTLVT VSS |
| VH | | | SEQ ID NO: 722 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSS |
| Linker | | | SEQ ID NO: 723 | GGGGSGGGGS |
| VH | | | SEQ ID NO: 724 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH wt QL | | | SEQ ID NO: 725 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPELLGGPSVFLFPPKPKDQLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVLHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD-Binding Protein Light Variable MAK199-1-GS-AE10-6 AM7 wtQL | MAK199-1 VL | AE10-6 AM7 VL | SEQ ID NO: 726 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKRGGSG GGGSGQAVVTQEPSLTVSPGGTVTLTCG SSTGTVTIDHYPYWFQQKPGQAPRTLIS DTDDKHSWTPARFSGSLLGGKAALTLSG AQPEDEAEYYCLLDYGGRFVFGGGTKLT VLG |
| VL | | | SEQ ID NO: 727 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKR |
| Linker | | | SEQ ID NO: 728 | GGSGGGGSG |
| VL | | | SEQ ID NO: 729 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 730 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK199-1-SS-AE10-6 AM7 wtQL | MAK199-1 VH | AE10-6 AM7 VH | SEQ ID NO: 731 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSSASTKGPEVQLVQSGAE VKKPGASVKVSCKVSGYTLTELSMHWVR QAPGKGLEWMGGFDPEDGETIYAQKFQG RVTMTEDTSTDTAYMELSSLRSEDTAVY YCATDTVGYWEKFFQHWGQGTLVTVSS |
| VH | | | SEQ ID NO: 732 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSS |
| Linker | | | SEQ ID NO: 733 | ASTKGP |
| VH | | | SEQ ID NO: 734 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH wt QL | | | SEQ ID NO: 735 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPELLGGPSVFLFPPKPKDQLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVLHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable MAK199-1-SS-AE10-6 AM7 wtQL | MAK199-1 VL | AE10-6 AM7 VL | SEQ ID NO: 736 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKRTVAA PQAVVTQEPSLTVSPGGTVTLTCGSSTG TVTIDHYPYWFQQKPGQAPRTLISDTDD KHSWTPARFSGSLLGGKAALTLSGAQPE DEAEYYCLLDYGGRFVFGGGTKLTVLG |
| VL | | | SEQ ID NO: 737 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKR |
| Linker | | | SEQ ID NO: 738 | TVAAP |
| VL | | | SEQ ID NO: 739 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 740 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK199-1-GS-AE10-6 AM7 wt | MAK199-1 VH | AE10-6 AM7 VH | SEQ ID NO: 741 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSSGGGGSGGGGSEVQLVQ SGAEVKKPGASVKVSCKVSGYTLTELSM HWVRQAPGKGLEWMGGFDPEDGETIYAQ KFQGRVTMTEDTSTDTAYMELSSLRSED TAVYYCATDTVGYWEKFFQHWGQGTLVT VSS |
| VH | | | SEQ ID NO: 742 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSS |
| Linker | | | SEQ ID NO: 743 | GGGGSGGGGS |
| VH | | | SEQ ID NO: 744 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH wt | | | SEQ ID NO: 745 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPELLGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable MAK199-1-GS-AE10-6 AM7 wt | MAK199-1 VL | AE10-6 AM7 VL | SEQ ID NO: 746 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKRGGSG GGGSGQAVVTQEPSLTVSPGGTVTLTCG SSTGTVTIDHYPYWFQQKPGQAPRTLIS DTDDKHSWTPARFSGSLLGGKAALTLSG AQPEDEAEYYCLLDYGGRFVFGGGTKLT VLG |
| VL | | | SEQ ID NO: 747 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKR |
| Linker | | | SEQ ID NO: 748 | GGSGGGGSG |
| VL | | | SEQ ID NO: 749 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 750 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK199-1-SS-AE10-6 AM7 wt | MAK199-1 VH | AE10-6 AM7 VH | SEQ ID NO: 751 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSSASTKGPEVQLVQSGAE VKKPGASVKVSCKVSGYTLTELSMHWVR QAPGKGLEWMGGFDPEDGETIYAQKFQG RVTMTEDTSTDTAYMELSSLRSEDTAVY YCATDTVGYWEKFFQHWGQGTLVTVSS |
| VH | | | SEQ ID NO: 752 | EVQLVQSGAEVKKPGASVKVSCKASGYT FANYGIIWVRQAPGQGLEWMGWINTYTG KPTYAQKFQGRVTMTTDTSTSTAYMELS SLRSEDTAVYYCARKLFTTMDVTDNAMD YWGQGTTVTVSS |
| Linker | | | SEQ ID NO: 753 | ASTKGP |
| VH | | | SEQ ID NO: 754 | EVQLVQSGAEVKKPGASVKVSCKVSGYT LTELSMHWVRQAPGKGLEWMGGFDPEDG ETIYAQKFQGRVTMTEDTSTDTAYMELS SLRSEDTAVYYCATDTVGYWEKFFQHWG QGTLVTVSS |
| CH wt | | | SEQ ID NO: 755 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPELLGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable MAK199-1-SS-AE10-6 AM7 wt | MAK199-1 VL | AE10-6 AM7 VL | SEQ ID NO: 756 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKRTVAA PQAVVTQEPSLTVSPGGTVTLTCGSSTG TVTIDHYPYWFQQKPGQAPRTLISDTDD KHSWTPARFSGSLLGGKAALTLSGAQPE DEAEYYCLLDYGGRFVFGGGTKLTVLG |
| VL | | | SEQ ID NO: 757 | DIQMTQSPSSLSASVGDRVTITCRASQD ISQYLNWYQQKPGKAPKLLIYYTSRLQS GVPSRFSGSGSGTDFTLTISSLQPEDFA TYFCQQGNTWPPTFGQGTKLEIKR |
| Linker | | | SEQ ID NO: 758 | TVAAP |
| VL | | | SEQ ID NO: 759 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 760 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable MAK195-21-GS-AE10-6 AM8 | MAK195-21 VH | AE10-6 AM8 VH | SEQ ID NO: 761 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSGGGGSGGGGSEVQLVQSGAEVKK PGASVKVSCKVSGYTLSELSIHWVRQAP GKGLEWMGGFDPEDGETIYAQKFQGRVT MTEDTSTDTAYMELSSLRSEDTAVYYCA TDSAGYWYKFFQHWGQGTLVTVSS |
| VH | | | SEQ ID NO: 762 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 763 | GGGGSGGGGS |
| VH | | | SEQ ID NO: 764 | EVQLVQSGAEVKKPGASVKVSCKVSGYT LSELSIHWVRQAPGKGLEWMGGFDPEDG ETIYAQKFQGRVTMTEDTSTDTAYMELS SLRSEDTAVYYCATDSAGYWYKFFQHWG QGTLVTVSS |
| CH | | | SEQ ID NO: 765 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 1234567890123456789012345678901234567890 |
|---|---|---|---|---|
| DVD-Binding Protein Light Variable MAK195-21-GS-AE10-6 AM8 | MAK-195-21 VL | AE10-6 AM8 VL | SEQ ID NO: 766 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKGGSGGGGSGQAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGSFVFGGGTKLTVLG |
| VL | | | SEQ ID NO: 767 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIK |
| Linker | | | SEQ ID NO: 768 | GGSGGGGSG |
| VL | | | SEQ ID NO: 769 | QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGSFVFGGGTKLTVLG |
| CL | | | SEQ ID NO: 770 | QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| DVD-Binding Protein Heavy Variable D2E7-GS-AE10-6 AM7 | D2E7 VH | AE10-6 AM7 VH | SEQ ID NO: 771 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSS |
| VH | | | SEQ ID NO: 772 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS |
| Linker | | | SEQ ID NO: 773 | GGGGSGGGGS |
| VH | | | SEQ ID NO: 774 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS |
| CH | | | SEQ ID NO: 775 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD-Binding Protein Light Variable D2E7-GS-AE10-6 AM7 | D2E7 VL | AE10-6 AM7 VL | SEQ ID NO: 776 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRGGSG GGGSGQAVVTQEPSLTVSPGGTVTLTCG SSTGTVTIDHYPYWFQQKPGQAPRTLIS DTDDKHSWTPARFSGSLLGGKAALTLSG AQPEDEAEYYCLLDYGGRFVFGGGTKLT VLG |
| VL | | | SEQ ID NO: 777 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 778 | GGSGGGGSG |
| VL | | | SEQ ID NO: 779 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 780 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD-Binding Protein Heavy Variable di D2E7-GS-AE10-6 AM7 | D2E7 VH | AE10-6 AM7 VH | SEQ ID NO: 781 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSGGGGSGGGGSEVQLVQSGA EVKKPGASVKVSCKVSGYTLTELSMHWV RQAPGKGLEWMGGFDPEDGETIYAQKFQ GRVTMTEDTSTDTAYMELSSLRSEDTAV YYCATDTVGYWEKFFQHWGQGTLVTVSS |
| VH | | | SEQ ID NO: 782 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 783 | GGGGSGGGGS |
| VH | | | SEQ ID NO: 784 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| CH | | | SEQ ID NO: 785 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD-Binding Protein Light Variable diD2E7-GS-AE10-6 AM7 | diD2E7ss VL | AE10-6 AM7 VL | SEQ ID NO: 786 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRGGSG GGGSGQAVVTQEPSLTVSPGGTVTLTCG SSTGTVTIDHYPYWFQQKPGQAPRTLIS DTDDKHSWTPARFSGSLLGGKAALTLSG AQPEDEAEYYCLLDYGGRFVFGGGTKLT VLG |
| VL | | | SEQ ID NO: 787 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 788 | GGSGGGGSG |
| VL | | | SEQ ID NO: 789 | QAVVTQEPSLTVSPGGTVTLTCGSSTGT VTIDHYPYWFQQKPGQAPRTLISDTDDK HSWTPARFSGSLLGGKAALTLSGAQPED EAEYYCLLDYGGRFVFGGGTKLTVLG |
| CL | | | SEQ ID NO: 790 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2577H | AB438VH | MSL10-AM1.2VH | SEQ ID NO: 791 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSGGGGSGGGGSEVQLVESGG GLVQPGRSLRLSCAASGFTFDDYALHWV RQAPGKGLEWVSGINWEGDDIDYADSVK GRFTISRDNAKNSLYLQMNSLRVEDTAL YYCAGNSRGYGGLDVWGQGTTVTVSS |
| VH | | | SEQ ID NO: 792 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 793 | GGGGSGGGGS |
| VH | | | SEQ ID NO: 794 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| CH | | | SEQ ID NO: 795 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence 12345678901234567890123456789 0 |
|---|---|---|---|---|
| DVD2577L | AB438VL | MSL10-AM1.2VL | SEQ ID NO: 796 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRGGSG GGGSGQSVLTQPPSASGTPGQRVTISCS GSSSNIGRNTVNWYQQLPGTAPKLLIYS NNQRPSGVPDRFSGSKSGTSASLAISGL QSEDEADYYCAAWDDNLESYVFGGGTKL TVLG |
| | VL | | SEQ ID NO: 797 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 798 | GGSGGGGSG |
| | VL | | SEQ ID NO: 799 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 800 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2578H | AB438VH | MSL10-AM1.2VH | SEQ ID NO: 801 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGINWEGDDIDYADSVKGRFT ISRDNAKNSLYLQMNSLRVEDTALYYCA GNSRGYGGLDVWGQGTTVTVSS |
| | VH | | SEQ ID NO: 802 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 803 | ASTKGP |
| | VH | | SEQ ID NO: 804 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 805 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence 12345678901234567890123456789 0 |
|---|---|---|---|---|
| DVD2578L | AB438VL | MSL10-AM1.2VL | SEQ ID NO: 806 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGRNTVNWYQQLPGTAPKLLIYSNNQR PSGVPDRFSGSKSGTSASLAISGLQSED EADYYCAAWDDNLESYVFGGGTKLTVLG |
| | VL | | SEQ ID NO: 807 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 808 | TVAAP |
| | VL | | SEQ ID NO: 809 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 810 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2579H | AB438VH | MSL10-AM1.2VH | SEQ ID NO: 811 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGINWEGDDIDYAD SVKGRFTISRDNAKNSLYLQMNSLRVED TALYYCAGNSRGYGGLDVWGQGTTVTVS S |
| | VH | | SEQ ID NO: 812 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 813 | ASTKGPSVFPLAP |
| | VH | | SEQ ID NO: 814 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 815 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2579L | AB438VL | MSL10-AM1.2VL | SEQ ID NO: 816 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGRNTVNWYQQLPGTAPKLL IYSNNQRPSGVPDRFSGSKSGTSASLAI SGLQSEDEADYYCAAWDDNLESYVFGGG TKLTVLG |
| VL | | | SEQ ID NO: 817 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 818 | TVAAPSVFIFPP |
| VL | | | SEQ ID NO: 819 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| CL | | | SEQ ID NO: 820 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2580H | AB438VH | MSL10-AM1.2VH | SEQ ID NO: 821 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGINWEGDDIDYADSVKGRFT ISRDNAKNSLYLQMNSLRVEDTALYYCA GNSRGYGGLDVWGQGTTVTVSS |
| VH | | | SEQ ID NO: 822 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 823 | ASTKGP |
| VH | | | SEQ ID NO: 824 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| CH | | | SEQ ID NO: 825 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence<br>12345678901234567890123456 7890 |
|---|---|---|---|---|
| DVD2580L | AB438VL | MSL10-AM1.2VL | SEQ ID NO: 826 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGRNTVNWYQQLPGTAPKLL IYSNNQRPSGVPDRFSGSKSGTSASLAI SGLQSEDEADYYCAAWDDNLESYVFGGG TKLTVLG |
| | VL | | SEQ ID NO: 827 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 828 | TVAAPSVFIFPP |
| | VL | | SEQ ID NO: 829 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 830 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2581H | AB438VH | MSL10-AM1.2VH | SEQ ID NO: 831 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGINWEGDDIDYAD SVKGRFTISRDNAKNSLYLQMNSLRVED TALYYCAGNSRGYGGLDVWGQGTTVTVS S |
| | VH | | SEQ ID NO: 832 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 833 | ASTKGPSVFPLAP |
| | VH | | SEQ ID NO: 834 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 835 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2581L | AB438VL | MSL10-AM1.2VL | SEQ ID NO: 836 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGRNTVNWYQQLPGTAPKLLIYSNNQR PSGVPDRFSGSKSGTSASLAISGLQSED EADYYCAAWDDNLESYVFGGGTKLTVLG |
| VL | | | SEQ ID NO: 837 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 838 | TVAAP |
| VL | | | SEQ ID NO: 839 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| CL | | | SEQ ID NO: 840 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2582H | AB438VH | MSL10-AM2.2VH | SEQ ID NO: 841 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSGGGGSGGGGSEVQLVESGG GLVQPGRSLRLSCAASGFTFDDYALHWV RQAPGKGLEWVSGIGWEDDMIDYADSVK GRFTISRDNAKNSLYLQMNSLRVEDTAL YYCAGNSRGYGGLDVWGQGTTVTVSS |
| VH | | | SEQ ID NO: 842 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 843 | GGGGSGGGGS |
| VH | | | SEQ ID NO: 844 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| CH | | | SEQ ID NO: 845 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD2582L | AB438VL | MSL10-AM2.2VL | SEQ ID NO: 846 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRGGSG GGGSGQSVLTQPPSASGTPGQRVTISCS GSSSNIGGNTVNWYQQLPGTAPKLLIYS NNQRPSGVPDRFSGSKSGTSASLAISGL QSEDEADYYCAAWDDSLEGSYVFGGGTK LTVLG |
| | VL | | SEQ ID NO: 847 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 848 | GGSGGGGSG |
| | VL | | SEQ ID NO: 849 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 850 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2583H | AB438VH | MSL10-AM2.2VH | SEQ ID NO: 851 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGIGWEDDMIDYADSVKGRFT ISRDNAKNSLYLQMNSLRVEDTALYYCA GNSRGYGGLDVWGQGTTVTVSS |
| | VH | | SEQ ID NO: 852 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 853 | ASTKGP |
| | VH | | SEQ ID NO: 854 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 855 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD2583L | AB438VL | MSL10-AM2.2VL | SEQ ID NO: 856 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGGNTVNWYQQLPGTAPKLLIYSNNQR PSGVPDRFSGSKSGTSASLAISGLQSED EADYYCAAWDDSLEGSYVFGGGTKLTVL G |
| | VL | | SEQ ID NO: 857 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 858 | TVAAP |
| | VL | | SEQ ID NO: 859 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 860 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2584H | AB438VH | MSL10-AM2.2VH | SEQ ID NO: 861 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGIGWEDDMIDYAD SVKGRFTISRDNAKNSLYLQMNSLRVED TALYYCAGNSRGYGGLDVWGQGTTVTVS S |
| | VH | | SEQ ID NO: 862 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 863 | ASTKGPSVFPLAP |
| | VH | | SEQ ID NO: 864 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 865 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456 7890 |
|---|---|---|---|---|
| DVD2584L | AB438VL | MSL10-AM2.2VL | SEQ ID NO: 866 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGGNTVNWYQQLPGTAPKLL IYSNNQRPSGVPDRFSGSKSGTSASLAI SGLQSEDEADYYCAAWDDSLEGSYVFGG GTKLTVLG |
| VL | | | SEQ ID NO: 867 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 868 | TVAAPSVFIFPP |
| VL | | | SEQ ID NO: 869 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| CL | | | SEQ ID NO: 870 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2585H | AB438VH | MSL10-AM2.2VH | SEQ ID NO: 871 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGIGWEDDMIDYADSVKGRFT ISRDNAKNSLYLQMNSLRVEDTALYYCA GNSRGYGGLDVWGQGTTVTVSS |
| VH | | | SEQ ID NO: 872 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 873 | ASTKGP |
| VH | | | SEQ ID NO: 874 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| CH | | | SEQ ID NO: 875 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2585L | AB438VL | MSL10-AM2.2VL | SEQ ID NO: 876 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGGNTVNWYQQLPGTAPKLL IYSNNQRPSGVPDRFSGSKSGTSASLAI SGLQSEDEADYYCAAWDDSLEGSYVFGG GTKLTVLG |
| VL | | | SEQ ID NO: 877 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 878 | TVAAPSVFIFPP |
| VL | | | SEQ ID NO: 879 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| CL | | | SEQ ID NO: 880 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2586H | AB438VH | MSL10-AM2.2VH | SEQ ID NO: 881 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGIGWEDDMIDYAD SVKGRFTISRDNAKNSLYLQMNSLRVED TALYYCAGNSRGYGGLDVWGQGTTVTVS S |
| VH | | | SEQ ID NO: 882 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 883 | ASTKGPSVFPLAP |
| VH | | | SEQ ID NO: 884 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| CH | | | SEQ ID NO: 885 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence<br>12345678901234567890123456789<u>0</u> |
|---|---|---|---|---|
| DVD2586L | AB438VL | MSL10-AM2.2VL | SEQ ID NO: 886 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGGNTVNWYQQLPGTAPKLLIYSNNQR PSGVPDRFSGSKSGTSASLAISGLQSED EADYYCAAWDDSLEGSYVFGGGTKLTVL G |
| | VL | | SEQ ID NO: 887 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 888 | TVAAP |
| | VL | | SEQ ID NO: 889 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 890 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2587H | AB438VH | MSL10-AM3.2VH | SEQ ID NO: 891 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSGGGGSGGGGSEVQLVESGG GLVQPGRSLRLSCAASGFTFDDYALHWV RQAPGKGLEWVSGIGWDEDMIDYADSVK GRFTISRDNAKNSLYLQMNSLRVEDTAL YYCAGNNRGYGGLDVWGQGTTVTVSS |
| | VH | | SEQ ID NO: 892 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 893 | GGGGSGGGGS |
| | VH | | SEQ ID NO: 894 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 895 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence<br>12345678901234567890123456789 0 |
|---|---|---|---|---|
| DVD2587L | AB438VL | MSL10-AM3.2VL | SEQ ID NO: 896 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRGGSG GGGSGQSVLTQPPSASGTPGQRVTISCS GSWSNIGSNTVNWYQQLPGTAPKLLIYN NNQRPSGVPDRFSGSKSGTSASLAISGL QSEDEADYYCAAWDDSLSGEYVFGGGTK LTVLG |
| | VL | | SEQ ID NO: 897 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 898 | GGSGGGGSG |
| | VL | | SEQ ID NO: 899 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 900 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2588H | AB438VH | MSL10-AM3.2VH | SEQ ID NO: 901 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGIGWDEDMIDYADSVKGRFT ISRDNAKNSLYLQMNSLRVEDTALYYCA GNNRGYGGLDVWGQGTTVTVSS |
| | VH | | SEQ ID NO: 902 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 903 | ASTKGP |
| | VH | | SEQ ID NO: 904 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 905 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence |
|---|---|---|---|---|
| DVD2588L | AB438VL | MSL10-AM3.2VH | SEQ ID NO: 906 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSWS NIGSNTVNWYQQLPGTAPKLLIYNNNQR PSGVPDRFSGSKSGTSASLAISGLQSED EADYYCAAWDDSLSGEYVFGGGTKLTVL G |
| | VL | | SEQ ID NO: 907 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 908 | TVAAP |
| | VL | | SEQ ID NO: 909 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 910 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2589H | AB438VH | MSL10-AM3.2VH | SEQ ID NO: 911 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGIGWDEDMIDYAD SVKGRFTISRDNAKNSLYLQMNSLRVED TALYYCAGNNRGYGGLDVWGQGTTVTVS S |
| | VH | | SEQ ID NO: 912 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 913 | ASTKGPSVFPLAP |
| | VH | | SEQ ID NO: 914 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 915 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2589L | AB438VL | MSL10-AM3.2VL | SEQ ID NO: 916 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSWSNIGSNTVNWYQQLPGTAPKLL IYNNNQRPSGVPDRFSGSKSGTSASLAI SGLQSEDEADYYCAAWDDSLSGEYVFGG GTKLTVLG |
| VL | | | SEQ ID NO: 917 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 918 | TVAAPSVFIFPP |
| VL | | | SEQ ID NO: 919 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| CL | | | SEQ ID NO: 920 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2590H | AB438VH | MSL10-AM3.2VH | SEQ ID NO: 921 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGIGWDEDMIDYADSVKGRFT ISRDNAKNSLYLQMNSLRVEDTALYYCA GNNRGYGGLDVWGQGTTVTVSS |
| VH | | | SEQ ID NO: 922 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 923 | ASTKGP |
| VH | | | SEQ ID NO: 924 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| CH | | | SEQ ID NO: 925 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Name | Outer Variable Domain Name | Inner Variable Domain Name | Sequence Identifier | Sequence<br>12345678901234567890123456 7890 |
|---|---|---|---|---|
| DVD2590L | AB438VL | MSL10-AM3.2VL | SEQ ID NO: 926 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSWSNIGSNTVNWYQQLPGTAPKLL IYNNNQRPSGVPDRFSGSKSGTSASLAI SGLQSEDEADYYCAAWDDSLSGEYVFGG GTKLTVLG |
| | VL | | SEQ ID NO: 927 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 928 | TVAAPSVFIFPP |
| | VL | | SEQ ID NO: 929 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 930 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2591H | AB438VH | MSL10-AM3.2VH | SEQ ID NO: 931 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGIGWDEDMIDYAD SVKGRFTISRDNAKNSLYLQMNSLRVED TALYYCAGNNRGYGGLDVWGQGTTVTVS S |
| | VH | | SEQ ID NO: 932 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 933 | ASTKGPSVFPLAP |
| | VH | | SEQ ID NO: 934 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 935 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence 12345678901234567890123456789 0 |
|---|---|---|---|---|
| DVD2591L | AB438VL | MSL10-AM3.2VL | SEQ ID NO: 936 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSWS NIGSNTVNWYQQLPGTAPKLLIYNNNQR PSGVPDRFSGSKSGTSASLAISGLQSED EADYYCAAWDDSLSGEYVFGGGTKLTVL G |
| | VL | | SEQ ID NO: 937 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 938 | TVAAP |
| | VL | | SEQ ID NO: 939 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 940 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2592H | AB438VH | MSL10-AM4.2VH | SEQ ID NO: 941 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSGGGGSGGGGSEVQLVESGG GLVQPGRSLRLSCAASGFTFEDYALHWV RQAPGKGLEWVSGIGWDDDMIDYADSVK GRFTISRDNAKNSLYLQMNSLRVEDTAL YYCAGNNRGYGGLDVWGQGTTVTVSS |
| | VH | | SEQ ID NO: 942 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 943 | GGGGSGGGGS |
| | VH | | SEQ ID NO: 944 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| | CH | | SEQ ID NO: 945 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2592L | AB438VL | MSL10-AM4.2VL | SEQ ID NO: 946 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRGGSG GGGSGQSVLTQPPSASGTPGQRVTISCS GSSSNIGSNTVNWYQQLPGTAPKLLIYN NNQRPSGVPDRFSGSKSGTSASLAISGL QSEDEADYYCAAWDDSLDSYVFGGGTKL TVLG |
| | VL | | SEQ ID NO: 947 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 948 | GGSGGGGSG |
| | VL | | SEQ ID NO: 949 | QSVLTQPPSASGTPGQRVTISCSGSSSN IGSNTVNWYQQLPGTAPKLLIYNNQRP SGVPDRFSGSKSGTSASLAISGLQSEDE ADYYCAAWDDSLDSYVFGGGTKLTVLG |
| | CL | | SEQ ID NO: 950 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2593H | AB438VH | MSL10-AM4.2VH | SEQ ID NO: 951 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFEDYALHWVRQAP GKGLEWVSGIGWDDDMIDYADSVKGRFT ISRDNAKNSLYLQMNSLRVEDTALYYCA GNNRGYGGLDVWGQGTTVTVSS |
| | VH | | SEQ ID NO: 952 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 953 | ASTKGP |
| | VH | | SEQ ID NO: 954 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| | CH | | SEQ ID NO: 955 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Name | Outer Variable Domain Name | Inner Variable Domain Name | Sequence Identifier | Sequence 12345678901234567890123456789 0 |
|---|---|---|---|---|
| DVD2593L | AB438VL | MSL10-AM4.2VH | SEQ ID NO: 956 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGSNTVNWYQQLPGTAPKLLIYNNNQR PSGVPDRFSGSKSGTSASLAISGLQSED EADYYCAAWDDSLDSYVFGGGTKLTVLG |
| | VL | | SEQ ID NO: 957 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 958 | TVAAP |
| | VL | | SEQ ID NO: 959 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| | CL | | SEQ ID NO: 960 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2594H | AB438VH | MSL10-AM4.2VH | SEQ ID NO: 961 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFEDYAL HWVRQAPGKGLEWVSGIGWDDDMIDYAD SVKGRFTISRDNAKNSLYLQMNSLRVED TALYYCAGNNRGYGGLDVWGQGTTVTVS S |
| | VH | | SEQ ID NO: 962 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 963 | ASTKGPSVFPLAP |
| | VH | | SEQ ID NO: 964 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| | CH | | SEQ ID NO: 965 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2594L | AB438VL | MSL10-AM4.2VL | SEQ ID NO: 966 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGSNTVNWYQQLPGTAPKLL IYNNNQRPSGVPDRFSGSKSGTSASLAI SGLQSEDEADYYCAAWDDSLDSYVFGGG TKLTVLG |
| VL | | | SEQ ID NO: 967 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 968 | TVAAPSVFIFPP |
| VL | | | SEQ ID NO: 969 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 970 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2595H | AB438VH | MSL10-AM4.2VH | SEQ ID NO: 971 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFEDYALHWVRQAP GKGLEWVSGIGWDDDMIDYADSVKGRFT ISRDNAKNSLYLQMNSLRVEDTALYYCA GNNRGYGGLDVWGQGTTVTVSS |
| VH | | | SEQ ID NO: 972 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 973 | ASTKGP |
| VH | | | SEQ ID NO: 974 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 975 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD2595L | AB438VL | MSL10-AM4.2VL | SEQ ID NO: 976 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGSNTVNWYQQLPGTAPKLL IYNNNQRPSGVPDRFSGSKSGTSASLAI SGLQSEDEADYYCAAWDDSLDSYVFGGG TKLTVLG |
| | VL | | SEQ ID NO: 977 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 978 | TVAAPSVFIFPP |
| | VL | | SEQ ID NO: 979 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| | CL | | SEQ ID NO: 980 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2596H | AB438VH | MSL10-AM4.2VH | SEQ ID NO: 981 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFEDYAL HWVRQAPGKGLEWVSGIGWDDDMIDYAD SVKGRFTISRDNAKNSLYLQMNSLRVED TALYYCAGNNRGYGGLDVWGQGTTVTVS S |
| | VH | | SEQ ID NO: 982 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 983 | ASTKGPSVFPLAP |
| | VH | | SEQ ID NO: 984 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| | CH | | SEQ ID NO: 985 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence  1234567890123456789012345678 90 |
|---|---|---|---|---|
| DVD2596L | AB438VL | MSL10-AM4.2VL | SEQ ID NO: 986 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGSNTVNWYQQLPGTAPKLLIYNNNQR PSGVPDRFSGSKSGTSASLAISGLQSED EADYYCAAWDDSLDSYVFGGGTKLTVLG |
| | VL | | SEQ ID NO: 987 | DIQMTQSPSSLSASVGDRVTITCRASQG IRNYLAWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 988 | TVAAP |
| | VL | | SEQ ID NO: 989 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| | CL | | SEQ ID NO: 990 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2597H | AB439VH | MSL10-AM1.2VH | SEQ ID NO: 991 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSGGGGSGGGGSEVQLVESGG GLVQPGRSLRLSCAASGFTFDDYALHWV RQAPGKGLEWVSGINWEGDDIDYADSVK GRFTISRDNAKNSLYLQMNSLRVEDTAL YYCAGNSRGYGGLDVWGQGTTVTVSS |
| | VH | | SEQ ID NO: 992 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 993 | GGGGSGGGGS |
| | VH | | SEQ ID NO: 994 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 995 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence 12345678901234567890123456789 0 |
|---|---|---|---|---|
| DVD2597L | AB439VL | MSL10-AM1.2VL | SEQ ID NO: 996 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRGGSG GGGSGQSVLTQPPSASGTPGQRVTISCS GSSSNIGRNTVNWYQQLPGTAPKLLIYS NNQRPSGVPDRFSGSKSGTSASLAISGL QSEDEADYYCAAWDDNLESYVFGGGTKL TVLG |
| | VL | | SEQ ID NO: 997 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 998 | GGSGGGGSG |
| | VL | | SEQ ID NO: 999 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 1000 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2598H | AB439VH | MSL10-AM1.2VH | SEQ ID NO: 1001 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGINWEGDDIDYADSVKGRFT ISRDNAKNSLYLQMNSLRVEDTALYYCA GNSRGYGGLDVWGQGTTVTVSS |
| | VH | | SEQ ID NO: 1002 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1003 | ASTKGP |
| | VH | | SEQ ID NO: 1004 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 1005 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 123456789012345678901234567890 |
|---|---|---|---|---|
| DVD2598L | AB439VL | MSL10-AM1.2VL | SEQ ID NO: 1006 | DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG |
| VL | | | SEQ ID NO: 1007 | DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKR |
| Linker | | | SEQ ID NO: 1008 | TVAAP |
| VL | | | SEQ ID NO: 1009 | QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG |
| CL | | | SEQ ID NO: 1010 | QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| DVD2599H | AB439VH | MSL10-AM1.2VH | SEQ ID NO: 1011 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS |
| VH | | | SEQ ID NO: 1012 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS |
| Linker | | | SEQ ID NO: 1013 | ASTKGPSVFPLAP |
| VH | | | SEQ ID NO: 1014 | EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS |
| CH | | | SEQ ID NO: 1015 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence |
|---|---|---|---|---|
| DVD2599L | AB439VL | MSL10-AM1.2VL | SEQ ID NO: 1016 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGRNTVNWYQQLPGTAPKLL IYSNNQRPSGVPDRFSGSKSGTSASLAI SGLQSEDEADYYCAAWDDNLESYVFGGG TKLTVLG |
| | VL | | SEQ ID NO: 1017 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1018 | TVAAPSVFIFPP |
| | VL | | SEQ ID NO: 1019 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 1020 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2600H | AB439VH | MSL10-AM1.2VH | SEQ ID NO: 1021 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGINWEGDDIDYADSVKGRFT ISRDNAKNSLYLQMNSLRVEDTALYYCA GNSRGYGGLDVWGQGTTVTVSS |
| | VH | | SEQ ID NO: 1022 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1023 | ASTKGP |
| | VH | | SEQ ID NO: 1024 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 1025 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence 12345678901234567890123456789 0 |
|---|---|---|---|---|
| DVD2600L | AB439VL | MSL10-AM1.2VL | SEQ ID NO: 1026 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGRNTVNWYQQLPGTAPKLL IYSNNQRPSGVPDRFSGSKSGTSASLAI SGLQSEDEADYYCAAWDDNLESYVFGGG TKLTVLG |
| | VL | | SEQ ID NO: 1027 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1028 | TVAAPSVFIFPP |
| | VL | | SEQ ID NO: 1029 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 1030 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2601H | AB439VH | MSL10-AM1.2VH | SEQ ID NO: 1031 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGINWEGDDIDYAD SVKGRFTISRDNAKNSLYLQMNSLRVED TALYYCAGNSRGYGGLDVWGQGTTVTVS S |
| | VH | | SEQ ID NO: 1032 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1033 | ASTKGPSVFPLAP |
| | VH | | SEQ ID NO: 1034 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 1035 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2601L | AB439VL | MSL10-AM1.2VL | SEQ ID NO: 1036 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGRNTVNWYQQLPGTAPKLLIYSNNQR PSGVPDRFSGSKSGTSASLAISGLQSED EADYYCAAWDDNLESYVFGGGTKLTVLG |
| VL | | | SEQ ID NO: 1037 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 1038 | TVAAP |
| VL | | | SEQ ID NO: 1039 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| CL | | | SEQ ID NO: 1040 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2602H | AB439VH | MSL10-AM2.2VH | SEQ ID NO: 1041 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSGGGGSGGGGSEVQLVESGG GLVQPGRSLRLSCAASGFTFDDYALHWV RQAPGKGLEWVSGIGWEDDMIDYADSVK GRFTISRDNAKNSLYLQMNSLRVEDTAL YYCAGNSRGYGGLDVWGQGTTVTVSS |
| VH | | | SEQ ID NO: 1042 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 1043 | GGGGSGGGGS |
| VH | | | SEQ ID NO: 1044 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| CH | | | SEQ ID NO: 1045 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Domain Name | Outer Variable Domain Name | Inner Variable Domain Name | Sequence Identifier | Sequence<br>12345678901234567890123456 7890 |
|---|---|---|---|---|
| DVD2602L | AB439VL | MSL10-AM2.2VL | SEQ ID NO: 1046 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRGGSG GGGSGQSVLTQPPSASGTPGQRVTISCS GSSSNIGGNTVNWYQQLPGTAPKLLIYS NNQRPSGVPDRFSGSKSGTSASLAISGL QSEDEADYYCAAWDDSLEGSYVFGGGTK LTVLG |
| VL | | | SEQ ID NO: 1047 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 1048 | GGSGGGGSG |
| VL | | | SEQ ID NO: 1049 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| CL | | | SEQ ID NO: 1050 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2603H | AB439VH | MSL10-AM2.2VH | SEQ ID NO: 1051 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGIGWEDDMIDYADSVKGRFT ISRDNAKNSLYLQMNSLRVEDTALYYCA GNSRGYGGLDVWGQGTTVTVSS |
| VH | | | SEQ ID NO: 1052 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 1053 | ASTKGP |
| VH | | | SEQ ID NO: 1054 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| CH | | | SEQ ID NO: 1055 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence<br>12345678901234567890123456 7890 |
|---|---|---|---|---|
| DVD2603L | AB439VL | MSL10-AM2.2VL | SEQ ID NO: 1056 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGGNTVNWYQQLPGTAPKLLIYSNNQR PSGVPDRFSGSKSGTSASLAISGLQSED EADYYCAAWDDSLEGSYVFGGGTKLTVL G |
| | VL | | SEQ ID NO: 1057 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1058 | TVAAP |
| | VL | | SEQ ID NO: 1059 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1060 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2604H | AB439VH | MSL10-AM2.2VH | SEQ ID NO: 1061 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGIGWEDDMIDYAD SVKGRFTISRDNAKNSLYLQMNSLRVED TALYYCAGNSRGYGGLDVWGQGTTVTVS S |
| | VH | | SEQ ID NO: 1062 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1063 | ASTKGPSVFPLAP |
| | VH | | SEQ ID NO: 1064 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 1065 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence 12345678901234567890123456789 0 |
|---|---|---|---|---|
| DVD2604L | AB439VL | MSL10-AM2.2VL | SEQ ID NO: 1066 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGGNTVNWYQQLPGTAPKLL IYSNNQRPSGVPDRFSGSKSGTSASLAI SGLQSEDEADYYCAAWDDSLEGSYVFGG GTKLTVLG |
| | VL | | SEQ ID NO: 1067 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1068 | TVAAPSVFIFPP |
| | VL | | SEQ ID NO: 1069 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1070 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2605H | AB439VH | MSL10-AM2.2VH | SEQ ID NO: 1071 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGIGWEDDMIDYADSVKGRFT ISRDNAKNSLYLQMNSLRVEDTALYYCA GNSRGYGGLDVWGQGTTVTVSS |
| | VH | | SEQ ID NO: 1072 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1073 | ASTKGP |
| | VH | | SEQ ID NO: 1074 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 1075 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD2605L | AB439VL | MSL10-AM2.2VL | SEQ ID NO: 1076 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGGNTVNWYQQLPGTAPKLL IYSNNQRPSGVPDRFSGSKSGTSASLAI SGLQSEDEADYYCAAWDDSLEGSYVFGG GTKLTVLG |
| | VL | | SEQ ID NO: 1077 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1078 | TVAAPSVFIFPP |
| | VL | | SEQ ID NO: 1079 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1080 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2606H | AB439VH | MSL10-AM2.2VH | SEQ ID NO: 1081 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGIGWEDDMIDYAD SVKGRFTISRDNAKNSLYLQMNSLRVED TALYYCAGNSRGYGGLDVWGQGTTVTVS S |
| | VH | | SEQ ID NO: 1082 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1083 | ASTKGPSVFPLAP |
| | VH | | SEQ ID NO: 1084 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 1085 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2606L | AB439VL | MSL10-AM2.2VL | SEQ ID NO: 1086 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGGNTVNWYQQLPGTAPKLLIYSNNQR PSGVPDRFSGSKSGTSASLAISGLQSED EADYYCAAWDDSLEGSYVFGGGTKLTVL G |
| VL | | | SEQ ID NO: 1087 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 1088 | TVAAP |
| VL | | | SEQ ID NO: 1089 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| CL | | | SEQ ID NO: 1090 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2607H | AB439VH | MSL10-AM3.2VH | SEQ ID NO: 1091 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSGGGGSGGGGSEVQLVESGG GLVQPGRSLRLSCAASGFTFDDYALHWV RQAPGKGLEWVSGIGWDEDMIDYADSVK GRFTISRDNAKNSLYLQMNSLRVEDTAL YYCAGNNRGYGGLDVWGQGTTVTVSS |
| VH | | | SEQ ID NO: 1092 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 1093 | GGGGSGGGGS |
| VH | | | SEQ ID NO: 1094 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| CH | | | SEQ ID NO: 1095 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Domain Name | Outer Variable Domain Name | Inner Variable Domain Name | Sequence Identifier | Sequence<br>12345678901234567890123456 7890 |
|---|---|---|---|---|
| DVD2607L | AB439VL | MSL10-AM3.2VL | SEQ ID NO: 1096 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRGGSG GGGSGQSVLTQPPSASGTPGQRVTISCS GSWSNIGSNTVNWYQQLPGTAPKLLIYN NNQRPSGVPDRFSGSKSGTSASLAISGL QSEDEADYYCAAWDDSLSGEYVFGGGTK LTVLG |
| | VL | | SEQ ID NO: 1097 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1098 | GGSGGGGSG |
| | VL | | SEQ ID NO: 1099 | QSVLTQPPSASGTPGQRVTISCSGSWSN IGSNTVNWYQQLPGTAPKLLIYNNQRP SGVPDRFSGSKSGTSASLAISGLQSEDE ADYYCAAWDDSLSGEYVFGGGTKLTVLG |
| | CL | | SEQ ID NO: 1100 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2608H | AB439VH | MSL10-AM3.2VH | SEQ ID NO: 1101 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGIGWDEDMIDYADSVKGRFT ISRDNAKNSLYLQMNSLRVEDTALYYCA GNNRGYGGLDVWGQGTTVTVSS |
| | VH | | SEQ ID NO: 1102 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1103 | ASTKGP |
| | VH | | SEQ ID NO: 1104 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 1105 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Name | Outer Variable Domain Name | Inner Variable Domain Name | Sequence Identifier | Sequence 12345678901234567890123 4567890 |
|---|---|---|---|---|
| DVD2608L | AB439VL | MSL10-AM3.2VH | SEQ ID NO: 1106 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSWS NIGSNTVNWYQQLPGTAPKLLIYNNNQR PSGVPDRFSGSKSGTSASLAISGLQSED EADYYCAAWDDSLSGEYVFGGGTKLTVL G |
| | VL | | SEQ ID NO: 1107 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1108 | TVAAP |
| | VL | | SEQ ID NO: 1109 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 1110 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2609H | AB439VH | MSL10-AM3.2VH | SEQ ID NO: 1111 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGIGWDEDMIDYAD SVKGRFTISRDNAKNSLYLQMNSLRVED TALYYCAGNNRGYGGLDVWGQGTTVTVS S |
| | VH | | SEQ ID NO: 1111 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1112 | ASTKGPSVFPLAP |
| | VH | | SEQ ID NO: 1113 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 1114 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2609L | AB439VL | MSL10-AM3.2VL | SEQ ID NO: 1115 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSWSNIGSNTVNWYQQLPGTAPKLL IYNNNQRPSGVPDRFSGSKSGTSASLAI SGLQSEDEADYYCAAWDDSLSGEYVFGG GTKLTVLG |
| VL | | | SEQ ID NO: 1117 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 1118 | TVAAPSVFIFPP |
| VL | | | SEQ ID NO: 1119 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| CL | | | SEQ ID NO: 1120 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2610H | AB439VH | MSL10-AM3.2VH | SEQ ID NO: 1121 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFDDYALHWVRQAP GKGLEWVSGIGWDEDMIDYADSVKGRFT ISRDNAKNSLYLQMNSLRVEDTALYYCA GNNRGYGGLDVWGQGTTVTVSS |
| VH | | | SEQ ID NO: 1122 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 1123 | ASTKGP |
| VH | | | SEQ ID NO: 1124 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| CH | | | SEQ ID NO: 1125 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence |
|---|---|---|---|---|
| DVD2610L | AB439VL | MSL10-AM3.2VL | SEQ ID NO: 1126 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSWSNIGSNTVNWYQQLPGTAPKLL IYNNNQRPSGVPDRFSGSKSGTSASLAI SGLQSEDEADYYCAAWDDSLSGEYVFGG GTKLTVLG |
| | VL | | SEQ ID NO: 1127 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1128 | TVAAPSVFIFPP |
| | VL | | SEQ ID NO: 1129 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 1130 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2611H | AB439VH | MSL10-AM3.2VH | SEQ ID NO: 1131 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFDDYAL HWVRQAPGKGLEWVSGIGWDEDMIDYAD SVKGRFTISRDNAKNSLYLQMNSLRVED TALYYCAGNNRGYGGLDVWGQGTTVTVS S |
| | VH | | SEQ ID NO: 1132 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1133 | ASTKGPSVFPLAP |
| | VH | | SEQ ID NO: 1134 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 1135 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2611L | AB439VL | MSL10-AM3.2VL | SEQ ID NO: 1136 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSWS NIGSNTVNWYQQLPGTAPKLLIYNNNQR PSGVPDRFSGSKSGTSASLAISGLQSED EADYYCAAWDDSLSGEYVFGGGTKLTVL G |
| VL | | | SEQ ID NO: 1137 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 1138 | TVAAP |
| VL | | | SEQ ID NO: 1139 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| CL | | | SEQ ID NO: 1140 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2612H | AB439VH | MSL10-AM4.2VH | SEQ ID NO: 1141 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSGGGGSGGGGSEVQLVESGG GLVQPGRSLRLSCAASGFTFEDYALHWV RQAPGKGLEWVSGIGWDDDMIDYADSVK GRFTISRDNAKNSLYLQMNSLRVEDTAL YYCAGNNRGYGGLDVWGQGTTVTVSS |
| VH | | | SEQ ID NO: 1142 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 1143 | GGGGSGGGGS |
| VH | | | SEQ ID NO: 1144 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 1145 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>123456789012345678901234567890 |
|---|---|---|---|---|
| DVD2612L | AB439VL | MSL10-AM4.2VL | SEQ ID NO: 1146 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRGGSG GGGSGQSVLTQPPSASGTPGQRVTISCS GSSSNIGSNTVNWYQQLPGTAPKLLIYN NNQRPSGVPDRFSGSKSGTSASLAISGL QSEDEADYYCAAWDDSLDSYVFGGGTKL TVLG |
| VL | | | SEQ ID NO: 1147 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 1148 | GGSGGGGSG |
| VL | | | SEQ ID NO: 1149 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 1150 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2613H | AB439VH | MSL10-AM4.2VH | SEQ ID NO: 1151 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFEDYALHWVRQAP GKGLEWVSGIGWDDDMIDYADSVKGRFT ISRDNAKNSLYLQMNSLRVEDTALYYCA GNNRGYGGLDVWGQGTTVTVSS |
| VH | | | SEQ ID NO: 1152 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| Linker | | | SEQ ID NO: 1153 | ASTKGP |
| VH | | | SEQ ID NO: 1154 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 1155 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 123456789012345678901234567890 |
|---|---|---|---|---|
| DVD2613L | AB439VL | MSL10-AM4.2VH | SEQ ID NO: 1156 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGSNTVNWYQQLPGTAPKLLIYNNNQR PSGVPDRFSGSKSGTSASLAISGLQSED EADYYCAAWDDSLDSYVFGGGTKLTVLG |
| | VL | | SEQ ID NO: 1157 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1158 | TVAAP |
| | VL | | SEQ ID NO: 1159 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| | CL | | SEQ ID NO: 1160 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2614H | AB439VH | MSL10-AM4.2VH | SEQ ID NO: 1161 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFEDYAL HWVRQAPGKGLEWVSGIGWDDDMIDYAD SVKGRFTISRDNAKNSLYLQMNSLRVED TALYYCAGNNRGYGGLDVWGQGTTVTVS S |
| | VH | | SEQ ID NO: 1162 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1163 | ASTKGPSVFPLAP |
| | VH | | SEQ ID NO: 1164 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| | CH | | SEQ ID NO: 1165 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence<br>123456789012345678901234567890 |
|---|---|---|---|---|
| DVD2614L | AB439VL | MSL10-AM4.2VL | SEQ ID NO: 1166 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGSNTVNWYQQLPGTAPKLL IYNNNQRPSGVPDRFSGSKSGTSASLAI SGLQSEDEADYYCAAWDDSLDSYVFGGG TKLTVLG |
| | VL | | SEQ ID NO: 1167 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1168 | TVAAPSVFIFPP |
| | VL | | SEQ ID NO: 1169 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| | CL | | SEQ ID NO: 1170 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2615H | AB439VH | MSL10-AM4.2VH | SEQ ID NO: 1171 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPEVQLVESGGGLVQ PGRSLRLSCAASGFTFEDYALHWVRQAP GKGLEWVSGIGWDDDMIDYADSVKGRFT ISRDNAKNSLYLQMNSLRVEDTALYYCA GNNRGYGGLDVWGQGTTVTVSS |
| | VH | | SEQ ID NO: 1172 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1173 | ASTKGP |
| | VH | | SEQ ID NO: 1174 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| | CH | | SEQ ID NO: 1175 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Name | Outer Variable Domain Name | Inner Variable Domain Name | Sequence Identifier | Sequence<br>12345678901234567890123456 7890 |
|---|---|---|---|---|
| DVD2615L | AB439VL | MSL10-AM4.2VL | SEQ ID NO: 1176 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PSVFIFPPQSVLTQPPSASGTPGQRVTI SCSGSSSNIGSNTVNWYQQLPGTAPKLL IYNNNQRPSGVPDRFSGSKSGTSASLAI SGLQSEDEADYYCAAWDDSLDSYVFGGG TKLTVLG |
| | VL | | SEQ ID NO: 1177 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| | Linker | | SEQ ID NO: 1178 | TVAAPSVFIFPP |
| | VL | | SEQ ID NO: 1179 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| | CL | | SEQ ID NO: 1180 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2616H | AB439VH | MSL10-AM4.2VH | SEQ ID NO: 1181 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSSASTKGPSVFPLAPEVQLVE SGGGLVQPGRSLRLSCAASGFTFEDYAL HWVRQAPGKGLEWVSGIGWDDDMIDYAD SVKGRFTISRDNAKNSLYLQMNSLRVED TALYYCAGNNRGYGGLDVWGQGTTVTVS S |
| | VH | | SEQ ID NO: 1182 | EVQLVESGGGLVQPGRSLRLSCAASGFT FDDYAMHWVRQAPGKGLEWVSAITWNSG HIDYADSVEGRFTISRDNAKNSLYLQMN SLRAEDTAVYYCAKVSYLSTASSLDYWG QGTLVTVSS |
| | Linker | | SEQ ID NO: 1183 | ASTKGPSVFPLAP |
| | VH | | SEQ ID NO: 1184 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| | CH | | SEQ ID NO: 1185 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2616L | AB439VL | MSL10-AM4.2VL | SEQ ID NO: 1186 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKRTVAA PQSVLTQPPSASGTPGQRVTISCSGSSS NIGSNTVNWYQQLPGTAPKLLIYNNNQR PSGVPDRFSGSKSGTSASLAISGLQSED EADYYCAAWDDSLDSYVFGGGTKLTVLG |
| VL | | | SEQ ID NO: 1187 | DIQMTQSPSSLSASVGDRVTITCRASQS IRNYLSWYQQKPGKAPKLLIYAASTLQS GVPSRFSGSGSGTDFTLTISSLQPEDVA TYYCQRYNRAPYTFGQGTKVEIKR |
| Linker | | | SEQ ID NO: 1188 | TVAAP |
| VL | | | SEQ ID NO: 1189 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 1190 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2617H | AB436VH | MSL10-AM1.2VH | SEQ ID NO: 1191 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSGGGGSGGGGSEVQLVESGGGLVQ PGRSLRLSCAASGFTFDDYALHWVRQAP GKGLEWVSGINWEGDDIDYADSVKGRFT ISRDNAKNSLYLQMNSLRVEDTALYYCA GNSRGYGGLDVWGQGTTVTVSS |
| VH | | | SEQ ID NO: 1192 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1193 | GGGGSGGGGS |
| VH | | | SEQ ID NO: 1194 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| CH | | | SEQ ID NO: 1195 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence 12345678901234567890123456789 0 |
|---|---|---|---|---|
| DVD2617L | AB436VL | MSL10-AM1.2VL | SEQ ID NO: 1196 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRGGSG GGGSGQSVLTQPPSASGTPGQRVTISCS GSSSNIGRNTVNWYQQLPGTAPKLLIYS NNQRPSGVPDRFSGSKSGTSASLAISGL QSEDEADYYCAAWDDNLESYVFGGGTKL TVLG |
| | VL | | SEQ ID NO: 1197 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Linker | | SEQ ID NO: 1198 | GGSGGGGSG |
| | VL | | SEQ ID NO: 1199 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 1200 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2618H | AB436VH | MSL10-AM1.2VH | SEQ ID NO: 1201 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGINWEGDDIDYADSVKGRFTISRD NAKNSLYLQMNSLRVEDTALYYCAGNSR GYGGLDVWGQGTTVTVSS |
| | VH | | SEQ ID NO: 1202 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| | Linker | | SEQ ID NO: 1203 | ASTKGP |
| | VH | | SEQ ID NO: 1204 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 1205 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD2618L | AB436VL | MSL10-AM1.2VL | SEQ ID NO: 1206 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PQSVLTQPPSASGTPGQRVTISCSGSSS NIGRNTVNWYQQLPGTAPKLLIYSNNQR PSGVPDRFSGSKSGTSASLAISGLQSED EADYYCAAWDDNLESYVFGGGTKLTVLG |
| VL | | | SEQ ID NO: 1207 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Linker | | | SEQ ID NO: 1208 | TVAAP |
| VL | | | SEQ ID NO: 1209 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| CL | | | SEQ ID NO: 1210 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2619H | AB436VH | MSL10-AM1.2VH | SEQ ID NO: 1211 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGINWEGDDIDYADSVKG RFTISRDNAKNSLYLQMNSLRVEDTALY YCAGNSRGYGGLDVWGQGTTVTVSS |
| VH | | | SEQ ID NO: 1212 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1213 | ASTKGPSVFPLAP |
| VH | | | SEQ ID NO: 1214 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| CH | | | SEQ ID NO: 1215 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Domain Name | Outer Variable Domain Name | Inner Variable Domain Name | Sequence Identifier | Sequence 12345678901234567890123456789 0 |
|---|---|---|---|---|
| DVD2619L | AB436VL | MSL10-AM1.2VL | SEQ ID NO: 1216 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PSVFIFPPQSVLTQPPSASGTPGQRVTI SCSGSSSNIGRNTVNWYQQLPGTAPKLL IYSNNQRPSGVPDRFSGSKSGTSASLAI SGLQSEDEADYYCAAWDDNLESYVFGGG TKLTVLG |
| | VL | | SEQ ID NO: 1217 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Linker | | SEQ ID NO: 1218 | TVAAPSVFIFPP |
| | VL | | SEQ ID NO: 1219 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 1220 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2620H | AB436VH | MSL10-AM1.2VH | SEQ ID NO: 1221 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGINWEGDDIDYADSVKGRFTISRD NAKNSLYLQMNSLRVEDTALYYCAGNSR GYGGLDVWGQGTTVTVSS |
| | VH | | SEQ ID NO: 1222 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| | Linker | | SEQ ID NO: 1223 | ASTKGP |
| | VH | | SEQ ID NO: 1224 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 1225 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2620L | AB436VL | MSL10-AM1.2VL | SEQ ID NO: 1226 | DIQMTQSPSSLSASVGDRVTITCRASQL TABLE 18-continued Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 1234567890123456789012345678 90 |
|---|---|---|---|---|
| DVD2621L | AB436VL | MSL10-AM1.2VL | SEQ ID NO: 1236 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG |
| VL | | | SEQ ID NO: 1237 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR |
| Linker | | | SEQ ID NO: 1238 | TVAAP |
| VL | | | SEQ ID NO: 1239 | QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG |
| CL | | | SEQ ID NO: 1240 | QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| DVD2622H | AB436VH | MSL10-AM2.2VH | SEQ ID NO: 1241 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS |
| VH | | | SEQ ID NO: 1242 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| Linker | | | SEQ ID NO: 1243 | GGGGSGGGGS |
| VH | | | SEQ ID NO: 1244 | EVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS |
| CH | | | SEQ ID NO: 1245 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2622L | AB436VL | MSL10-AM2.2VL | SEQ ID NO: 1246 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRGGSG GGGSGQSVLTQPPSASGTPGQRVTISCS GSSSNIGGNTVNWYQQLPGTAPKLLIYS NNQRPSGVPDRFSGSKSGTSASLAISGL QSEDEADYYCAAWDDSLEGSYVFGGGTK LTVLG |
| | VL | | SEQ ID NO: 1247 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Linker | | SEQ ID NO: 1248 | GGSGGGGSG |
| | VL | | SEQ ID NO: 1249 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1250 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2623H | AB436VH | MSL10-AM2.2VH | SEQ ID NO: 1251 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGIGWEDDMIDYADSVKGRFTISRD NAKNSLYLQMNSLRVEDTALYYCAGNSR GYGGLDVWGQGTTVTVSS |
| | VH | | SEQ ID NO: 1252 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| | Linker | | SEQ ID NO: 1253 | ASTKGP |
| | VH | | SEQ ID NO: 1254 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 1255 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2623L | AB436VL | MSL10-AM2.2VL | SEQ ID NO: 1256 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PQSVLTQPPSASGTPGQRVTISCSGSSS NIGGNTVNWYQQLPGTAPKLLIYSNNQR PSGVPDRFSGSKSGTSASLAISGLQSED EADYYCAAWDDSLEGSYVFGGGTKLTVL G |
| | VL | | SEQ ID NO: 1257 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Linker | | SEQ ID NO: 1258 | TVAAP |
| | VL | | SEQ ID NO: 1259 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1260 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2624H | AB436VH | MSL10-AM2.2VH | SEQ ID NO: 1261 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGIGWEDDMIDYADSVKG RFTISRDNAKNSLYLQMNSLRVEDTALY YCAGNSRGYGGLDVWGQGTTVTVSS |
| | VH | | SEQ ID NO: 1262 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| | Linker | | SEQ ID NO: 1263 | ASTKGPSVFPLAP |
| | VH | | SEQ ID NO: 1264 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 1265 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2624L | AB436VL | MSL10-AM2.2VL | SEQ ID NO: 1266 | DIQMTQSPSSLSASVGDRVTITCRASQL VSSAVAWYQQKPGKAPLLIYWASARHT GVPSRFSGSGSGTDFTLTISSLQPEDFA TYYCQQHYKTPFTFGQGTKLEIKRTVAA PSVFIFPPQSVLTQPPSASGTPGQRVTI SCSGSSSNIGGNTVNWYQQLPGTAPKLL IYSNNQRPSGVPDRFSGSKSGTSASLAI SGLQSEDEADYYCAAWDDSLEGSYVFGG GTKLTVLG |
| VL | | | SEQ ID NO: 1267 | DIQMTQSPSSLSASVGDRVTITCRASQL VSSAVAWYQQKPGKAPLLIYWASARHT GVPSRFSGSGSGTDFTLTISSLQPEDFA TYYCQQHYKTPFTFGQGTKLEIKR |
| Linker | | | SEQ ID NO: 1268 | TVAAPSVFIFPP |
| VL | | | SEQ ID NO: 1269 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| CL | | | SEQ ID NO: 1270 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2625H | AB436VH | MSL10-AM2.2VH | SEQ ID NO: 1271 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGIGWEDDMIDYADSVKGRFTISRD NAKNSLYLQMNSLRVEDTALYYCAGNSR GYGGLDVWGQGTTVTVSS |
| VH | | | SEQ ID NO: 1272 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1273 | ASTKGP |
| VH | | | SEQ ID NO: 1274 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| CH | | | SEQ ID NO: 1275 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence |
|---|---|---|---|---|
| DVD2625L | AB436VL | MSL10-AM2.2VL | SEQ ID NO: 1276 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PSVFIFPPQSVLTQPPSASGTPGQRVTI SCSGSSSNIGGNTVNWYQQLPGTAPKLL IYSNNQRPSGVPDRFSGSKSGTSASLAI SGLQSEDEADYYCAAWDDSLEGSYVFGG GTKLTVLG |
| | VL | | SEQ ID NO: 1277 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Linker | | SEQ ID NO: 1278 | TVAAPSVFIFPP |
| | VL | | SEQ ID NO: 1279 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1280 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2626H | AB436VH | MSL10-AM2.2VH | SEQ ID NO: 1281 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGIGWEDDMIDYADSVKG RFTISRDNAKNSLYLQMNSLRVEDTALY YCAGNSRGYGGLDVWGQGTTVTVSS |
| | VH | | SEQ ID NO: 1282 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| | Linker | | SEQ ID NO: 1283 | ASTKGPSVFPLAP |
| | VH | | SEQ ID NO: 1284 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 1285 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2626L | AB436VL | MSL10-AM2.2VL | SEQ ID NO: 1286 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PQSVLTQPPSASGTPGQRVTISCSGSSS NIGGNTVNWYQQLPGTAPKLLIYSNNQR PSGVPDRFSGSKSGTSASLAISGLQSED EADYYCAAWDDSLEGSYVFGGGTKLTVL G |
| VL | | | SEQ ID NO: 1287 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Linker | | | SEQ ID NO: 1288 | TVAAP |
| VL | | | SEQ ID NO: 1289 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| CH | | | SEQ ID NO: 1290 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |
| DVD2627H | AB436VH | MSL10-AM3.2VH | SEQ ID NO: 1291 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSGGGGSGGGGSEVQLVESGGGLVQ PGRSLRLSCAASGFTFDDYALHWVRQAP GKGLEWVSGIGWDEDMIDYADSVKGRFT ISRDNAKNSLYLQMNSLRVEDTALYYCA GNNRGYGGLDVWGQGTTVTVSS |
| VH | | | SEQ ID NO: 1292 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1293 | GGGGSGGGGS |
| VH | | | SEQ ID NO: 1294 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| CH | | | SEQ ID NO: 1295 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV |

TABLE 18-continued

Sequences Of Variable And Constant Regions Of
TNF/SOST DVD-Binding Proteins

| DVD-Binding Protein Variable Name | Outer Variable Domain Name | Inner Variable Domain Name | Sequence Identifier | Sequence 12345678901234567890123 4567890 |
|---|---|---|---|---|
| | | | | KGFYPSDIAVEWESNGQPENNYKTTPPV LDSDGSFFLYSKLTVDKSRWQQGNVFSC SVMHEALHNHYTQKSLSLSPGK |
| DVD2627L | AB436VL | MSL10-AM3.2VL | SEQ ID NO: 1296 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRGGSG GGGSGQSVLTQPPSASGTPGQRVTISCS GSWSNIGSNTVNWYQQLPGTAPKLLIYN NNQRPSGVPDRFSGSKSGTSASLAISGL QSEDEADYYCAAWDDSLSGEYVFGGGTK LTVLG |
| VL | | | SEQ ID NO: 1297 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Linker | | | SEQ ID NO: 1298 | GGSGGGGSG |
| VL | | | SEQ ID NO: 1299 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| CL | | | SEQ ID NO: 1300 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2628H | AB436VH | MSL10-AM3.2VH | SEQ ID NO: 1301 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGIGWDEDMIDYADSVKGRFTISRD NAKNSLYLQMNSLRVEDTALYYCAGNNR GYGGLDVWGQGTTVTVSS |
| VH | | | SEQ ID NO: 1302 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1303 | ASTKGP |
| VH | | | SEQ ID NO: 1304 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| CH | | | SEQ ID NO: 1305 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2628L | AB436VL | MSL10-AM3.2VL | SEQ ID NO: 1306 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PQSVLTQPPSASGTPGQRVTISCSGSWS NIGSNTVNWYQQLPGTAPKLLIYNNNQR PSGVPDRFSGSKSGTSASLAISGLQSED EADYYCAAWDDSLSGEYVFGGGTKLTVL G |
| VL | | | SEQ ID NO: 1307 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Linker | | | SEQ ID NO: 1308 | TVAAP |
| VL | | | SEQ ID NO: 1309 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| CL | | | SEQ ID NO: 1310 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2629H | AB436VH | MSL10-AM3.2VH | SEQ ID NO: 1311 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGIGWDEDMIDYADSVKG RFTISRDNAKNSLYLQMNSLRVEDTALY YCAGNNRGYGGLDVWGQGTTVTVSS |
| VH | | | SEQ ID NO: 1312 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1313 | ASTKGPSVFPLAP |
| VH | | | SEQ ID NO: 1314 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| CH | | | SEQ ID NO: 1315 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2629L | AB436VL | MSL10-AM3.2VL | SEQ ID NO: 1316 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PSVFIFPPQSVLTQPPSASGTPGQRVTI SCSGSWSNIGSNTVNWYQQLPGTAPKLL IYNNNQRPSGVPDRFSGSKSGTSASLAI SGLQSEDEADYYCAAWDDSLSGEYVFGG GTKLTVLG |
| VL | | | SEQ ID NO: 1317 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Linker | | | SEQ ID NO: 1318 | TVAAPSVFIFPP |
| VL | | | SEQ ID NO: 1319 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| CL | | | SEQ ID NO: 1320 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2630H | AB436VH | MSL10-AM3.2VH | SEQ ID NO: 1321 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGIGWDEDMIDYADSVKGRFTISRD NAKNSLYLQMNSLRVEDTALYYCAGNNR GYGGLDVWGQGTTVTVSS |
| VH | | | SEQ ID NO: 1322 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1323 | ASTKGP |
| VH | | | SEQ ID NO: 1324 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| CH | | | SEQ ID NO: 1325 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 123456789012345678901234567890 |
|---|---|---|---|---|
| DVD2630L | AB436VL | MSL10-AM3.2VL | SEQ ID NO: 1326 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PSVFIFPPQSVLTQPPSASGTPGQRVTI SCSGSWSNIGSNTVNWYQQLPGTAPKLL IYNNNQRPSGVPDRFSGSKSGTSASLAI SGLQSEDEADYYCAAWDDSLSGEYVFGG GTKLTVLG |
| | VL | | SEQ ID NO: 1327 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Linker | | SEQ ID NO: 1328 | TVAAPSVFIFPP |
| | VL | | SEQ ID NO: 1329 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 1330 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2631H | AB436VH | MSL10-AM3.2VH | SEQ ID NO: 1331 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGIGWDEDMIDYADSVKG RFTISRDNAKNSLYLQMNSLRVEDTALY YCAGNNRGYGGLDVWGQGTTVTVSS |
| | VH | | SEQ ID NO: 1332 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| | Linker | | SEQ ID NO: 1333 | ASTKGPSVFPLAP |
| | VH | | SEQ ID NO: 1334 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 1335 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 1234567890123456789012345678901234567890 |
|---|---|---|---|---|
| DVD2631L | AB436VL | MSL10-AM3.2VL | SEQ ID NO: 1336 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG |
| VL | | | SEQ ID NO: 1337 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR |
| Linker | | | SEQ ID NO: 1338 | TVAAP |
| VL | | | SEQ ID NO: 1339 | QSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG |
| CL | | | SEQ ID NO: 1340 | QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| DVD2632H | AB436VH | MSL10-AM4.2VH | SEQ ID NO: 1341 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS |
| VH | | | SEQ ID NO: 1342 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| Linker | | | SEQ ID NO: 1343 | GGGGSGGGGS |
| VH | | | SEQ ID NO: 1344 | EVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS |
| CH | | | SEQ ID NO: 1345 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2632L | AB436VL | MSL10-AM4.2VL | SEQ ID NO: 1346 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRGGSG GGGSGQSVLTQPPSASGTPGQRVTISCS GSSSNIGSNTVNWYQQLPGTAPKLLIYN NNQRPSGVPDRFSGSKSGTSASLAISGL QSEDEADYYCAAWDDSLDSYVFGGGTKL TVLG |
| VL | | | SEQ ID NO: 1347 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Linker | | | SEQ ID NO: 1348 | GGSGGGGSG |
| VL | | | SEQ ID NO: 1349 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 1350 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2633H | AB436VH | MSL10-AM4.2VH | SEQ ID NO: 1351 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPEVQLVESGGGLVQPGRS LRLSCAASGFTFEDYALHWVRQAPGKGL EWVSGIGWDDDMIDYADSVKGRFTISRD NAKNSLYLQMNSLRVEDTALYYCAGNNR GYGGLDVWGQGTTVTVSS |
| VH | | | SEQ ID NO: 1352 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1353 | ASTKGP |
| VH | | | SEQ ID NO: 1354 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 1355 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 123456789012345678901234567890 |
|---|---|---|---|---|
| DVD2633L | AB436VL | MSL10-AM4.2VL | SEQ ID NO: 1356 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PQSVLTQPPSASGTPGQRVTISCSGSSS NIGSNTVNWYQQLPGTAPKLLIYNNNQR PSGVPDRFSGSKSGTSASLAISGLQSED EADYYCAAWDDSLDSYVFGGGTKLTVLG |
| VL | | | SEQ ID NO: 1357 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Linker | | | SEQ ID NO: 1358 | TVAAP |
| VL | | | SEQ ID NO: 1359 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 1360 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2634H | AB436VH | MSL10-AM4.2VH | SEQ ID NO: 1361 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPSVFPLAPEVQLVESGGG LVQPGRSLRLSCAASGFTFEDYALHWVR QAPGKGLEWVSGIGWDDDMIDYADSVKG RFTISRDNAKNSLYLQMNSLRVEDTALY YCAGNNRGYGGLDVWGQGTTVTVSS |
| VH | | | SEQ ID NO: 1362 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1363 | ASTKGPSVFPLAP |
| VH | | | SEQ ID NO: 1364 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 1365 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2634L | AB436VL | MSL10-AM4.2VL | SEQ ID NO: 1366 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PSVFIFPPQSVLTQPPSASGTPGQRVTI SCSGSSSNIGSNTVNWYQQLPGTAPKLL IYNNNQRPSGVPDRFSGSKSGTSASLAI SGLQSEDEADYYCAAWDDSLDSYVFGGG TKLTVLG |
| | VL | | SEQ ID NO: 1367 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Linker | | SEQ ID NO: 1368 | TVAAPSVFIFPP |
| | VL | | SEQ ID NO: 1369 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| | CL | | SEQ ID NO: 1370 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2635H | AB436VH | MSL10-AM4.2VH | SEQ ID NO: 1371 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPEVQLVESGGGLVQPGRS LRLSCAASGFTFEDYALHWVRQAPGKGL EWVSGIGWDDDMIDYADSVKGRFTISRD NAKNSLYLQMNSLRVEDTALYYCAGNNR GYGGLDVWGQGTTVTVSS |
| | VH | | SEQ ID NO: 1372 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| | Linker | | SEQ ID NO: 1373 | ASTKGP |
| | VH | | SEQ ID NO: 1374 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| | CH | | SEQ ID NO: 1375 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890 |
|---|---|---|---|---|
| DVD2635L | AB436VL | MSL10-AM4.2VL | SEQ ID NO: 1376 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKRTVAA PSVFIFPPQSVLTQPPSASGTPGQRVTI SCSGSSSNIGSNTVNWYQQLPGTAPKLL IYNNNQRPSGVPDRFSGSKSGTSASLAI SGLQSEDEADYYCAAWDDSLDSYVFGGG TKLTVLG |
| VL | | | SEQ ID NO: 1377 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Linker | | | SEQ ID NO: 1378 | TVAAPSVFIFPP |
| VL | | | SEQ ID NO: 1379 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 1380 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2636H | AB436VH | MSL10-AM4.2VH | SEQ ID NO: 1381 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSSASTKGPSVFPLAPEVQLVESGGG LVQPGRSLRLSCAASGFTFEDYALHWVR QAPGKGLEWVSGIGWDDDMIDYADSVKG RFTISRDNAKNSLYLQMNSLRVEDTALY YCAGNNRGYGGLDVWGQGTTVTVSS |
| VH | | | SEQ ID NO: 1382 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| Linker | | | SEQ ID NO: 1383 | ASTKGPSVFPLAP |
| VH | | | SEQ ID NO: 1384 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 1385 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 1234567890123456789012345678901234567890 |
|---|---|---|---|---|
| DVD2636L | AB436VL | MSL10-AM4.2VL | SEQ ID NO: 1386 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG |
| VL | | | SEQ ID NO: 1387 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR |
| Linker | | | SEQ ID NO: 1388 | TVAAP |
| VL | | | SEQ ID NO: 1389 | QSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG |
| CL | | | SEQ ID NO: 1390 | QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| DVD2637H | AB437VH | MSL10-AM1.2VH | SEQ ID NO: 1391 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS |
| VH | | | SEQ ID NO: 1392 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |
| Linker | | | SEQ ID NO: 1393 | GGGGSGGGGS |
| VH | | | SEQ ID NO: 1394 | EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS |
| CH | | | SEQ ID NO: 1395 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 18-continued

Sequences Of Variable And Constant Regions Of TNF/SOST DVD-Binding Proteins

| DVD-Binding Protein Name | Outer Variable Domain Name | Inner Variable Domain Name | Sequence Identifier | Sequence 12345678901234567890123456789 0 |
|---|---|---|---|---|
| DVD2637L | AB437VL | MSL10-AM1.2VL | SEQ ID NO: 1396 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRGGSG GGGSGQSVLTQPPSASGTPGQRVTISCS GSSSNIGRNTVNWYQQLPGTAPKLLIYS NNQRPSGVPDRFSGSKSGTSASLAISGL QSEDEADYYCAAWDDNLESYVFGGGTKL TVLG |
| | VL | | SEQ ID NO: 1397 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1398 | GGSGGGGSG |
| | VL | | SEQ ID NO: 1399 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 1400 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2638H | AB437VH | MSL10-AM1.2VH | SEQ ID NO: 1401 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGINWEGDDIDYADSVKGRFTISRD NAKNSLYLQMNSLRVEDTALYYCAGNSR GYGGLDVWGQGTTVTVSS |
| | VH | | SEQ ID NO: 1402 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1403 | ASTKGP |
| | VH | | SEQ ID NO: 1404 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 1405 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 1234567890123456789012345678901234567890 |
|---|---|---|---|---|
| DVD2638L | AB437VL | MSL10-AM1.2VL | SEQ ID NO: 1406 | DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG |
| VL | | | SEQ ID NO: 1407 | DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKR |
| Linker | | | SEQ ID NO: 1408 | TVAAP |
| VL | | | SEQ ID NO: 1409 | QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG |
| CL | | | SEQ ID NO: 1410 | QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| DVD2639H | AB437VH | MSL10-AM1.2VH | SEQ ID NO: 1411 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPSVFPLAPEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS |
| VH | | | SEQ ID NO: 1412 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |
| Linker | | | SEQ ID NO: 1413 | ASTKGPSVFPLAP |
| VH | | | SEQ ID NO: 1414 | EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS |
| CH | | | SEQ ID NO: 1415 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence |
|---|---|---|---|---|
| DVD2639L | AB437VL | MSL10-AM1.2VL | SEQ ID NO: 1416 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PSVFIFPPQSVLTQPPSASGTPGQRVTI SCSGSSSNIGRNTVNWYQQLPGTAPKLL IYSNNQRPSGVPDRFSGSKSGTSASLAI SGLQSEDEADYYCAAWDDNLESYVFGGG TKLTVLG |
| | VL | | SEQ ID NO: 1417 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1418 | TVAAPSVFIFPP |
| | VL | | SEQ ID NO: 1419 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | CL | | SEQ ID NO: 1420 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2640H | AB437VH | MSL10-AM1.2VH | SEQ ID NO: 1421 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGINWEGDDIDYADSVKGRFTISRD NAKNSLYLQMNSLRVEDTALYYCAGNSR GYGGLDVWGQGTTVTVSS |
| | VH | | SEQ ID NO: 1422 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1423 | ASTKGP |
| | VH | | SEQ ID NO: 1424 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | CH | | SEQ ID NO: 1425 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2640L | AB437VL | MSL10-AM1.2VL | SEQ ID NO: 1426 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PSVFIFPPQSVLTQPPSASGTPGQRVTI SCSGSSSNIGRNTVNWYQQLPGTAPKLL IYSNNQRPSGVPDRFSGSKSGTSASLAI SGLQSEDEADYYCAAWDDNLESYVFGGG TKLTVLG |
| VL | | | SEQ ID NO: 1427 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Linker | | | SEQ ID NO: 1428 | TVAAPSVFIFPP |
| VL | | | SEQ ID NO: 1429 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| CL | | | SEQ ID NO: 1430 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2641H | AB437VH | MSL10-AM1.2VH | SEQ ID NO: 1431 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGINWEGDDIDYADSVKG RFTISRDNAKNSLYLQMNSLRVEDTALY YCAGNSRGYGGLDVWGQGTTVTVSS |
| VH | | | SEQ ID NO: 1432 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| Linker | | | SEQ ID NO: 1433 | ASTKGPSVFPLAP |
| VH | | | SEQ ID NO: 1434 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| CH | | | SEQ ID NO: 1435 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 123456789012345678901234567890 |
|---|---|---|---|---|
| DVD2641L | AB437VL | MSL10-AM1.2VL | SEQ ID NO: 1436 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PQSVLTQPPSASGTPGQRVTISCSGSSS NIGRNTVNWYQQLPGTAPKLLIYSNNQR PSGVPDRFSGSKSGTSASLAISGLQSED EADYYCAAWDDNLESYVFGGGTKLTVLG |
| VL | | | SEQ ID NO: 1437 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Linker | | | SEQ ID NO: 1438 | TVAAP |
| VL | | | SEQ ID NO: 1439 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| CL | | | SEQ ID NO: 1440 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2642H | AB437VH | MSL10-AM2.2VH | SEQ ID NO: 1441 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSGGGGSGGGGSEVQLVESGGGLVQ PGRSLRLSCAASGFTFDDYALHWVRQAP GKGLEWVSGIGWEDDMIDYADSVKGRFT ISRDNAKNSLYLQMNSLRVEDTALYYCA GNSRGYGGLDVWGQGTTVTVSS |
| VH | | | SEQ ID NO: 1442 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| Linker | | | SEQ ID NO: 1443 | GGGGSGGGGS |
| VH | | | SEQ ID NO: 1444 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| CH | | | SEQ ID NO: 1445 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2642L | AB437VL | MSL10-AM2.2VL | SEQ ID NO: 1446 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRGGSG GGGSGQSVLTQPPSASGTPGQRVTISCS GSSSNIGGNTVNWYQQLPGTAPKLLIYS NNQRPSGVPDRFSGSKSGTSASLAISGL QSEDEADYYCAAWDDSLEGSYVFGGGTK LTVLG |
| | VL | | SEQ ID NO: 1447 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1448 | GGSGGGGSG |
| | VL | | SEQ ID NO: 1449 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1450 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2643H | AB437VH | MSL10-AM2.2VH | SEQ ID NO: 1451 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGIGWEDDMIDYADSVKGRFTISRD NAKNSLYLQMNSLRVEDTALYYCAGNSR GYGGLDVWGQGTTVTVSS |
| | VH | | SEQ ID NO: 1452 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1453 | ASTKGP |
| | VH | | SEQ ID NO: 1454 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 1455 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2643L | AB437VL | MSL10-AM2.2VL | SEQ ID NO: 1456 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PQSVLTQPPSASGTPGQRVTISCSGSSS NIGGNTVNWYQQLPGTAPKLLIYSNNQR PSGVPDRFSGSKSGTSASLAISGLQSED EADYYCAAWDDSLEGSYVFGGGTKLTVL G |
| VL | | | SEQ ID NO: 1457 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Linker | | | SEQ ID NO: 1458 | TVAAP |
| VL | | | SEQ ID NO: 1459 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| CL | | | SEQ ID NO: 1460 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2644H | AB437VH | MSL10-AM2.2VH | SEQ ID NO: 1461 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGIGWEDDMIDYADSVKG RFTISRDNAKNSLYLQMNSLRVEDTALY YCAGNSRGYGGLDVWGQGTTVTVSS |
| VH | | | SEQ ID NO: 1462 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| Linker | | | SEQ ID NO: 1463 | ASTKGPSVFPLAP |
| VH | | | SEQ ID NO: 1464 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| CH | | | SEQ ID NO: 1465 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2644L | AB437VL | MSL10-AM2.2VL | SEQ ID NO: 1466 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PSVFIFPPQSVLTQPPSASGTPGQRVTI SCSGSSSNIGGNTVNWYQQLPGTAPKLL IYSNNQRPSGVPDRFSGSKSGTSASLAI SGLQSEDEADYYCAAWDDSLEGSYVFGG GTKLTVLG |
| | VL | | SEQ ID NO: 1467 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1468 | TVAAPSVFIFPP |
| | | VL | SEQ ID NO: 1469 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1470 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2645H | AB437VH | MSL10-AM2.2VH | SEQ ID NO: 1471 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGIGWEDDMIDYADSVKGRFTISRD NAKNSLYLQMNSLRVEDTALYYCAGNSR GYGGLDVWGQGTTVTVSS |
| | VH | | SEQ ID NO: 1472 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1473 | ASTKGP |
| | | VH | SEQ ID NO: 1474 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 1475 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Domain Name | Outer Variable Domain Name | Inner Variable Domain Name | Sequence Identifier | Sequence 12345678901234567890123456789 0 |
|---|---|---|---|---|
| DVD2645L | AB437VL | MSL10-AM2.2VL | SEQ ID NO: 1476 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PSVFIFPPQSVLTQPPSASGTPGQRVTI SCSGSSSNIGGNTVNWYQQLPGTAPKLL IYSNNQRPSGVPDRFSGSKSGTSASLAI SGLQSEDEADYYCAAWDDSLEGSYVFGG GTKLTVLG |
| | VL | | SEQ ID NO: 1477 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1478 | TVAAPSVFIFPP |
| | VL | | SEQ ID NO: 1479 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1480 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2646H | AB437VH | MSL10-AM2.2VH | SEQ ID NO: 1481 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGIGWEDDMIDYADSVKG RFTISRDNAKNSLYLQMNSLRVEDTALY YCAGNSRGYGGLDVWGQGTTVTVSS |
| | VH | | SEQ ID NO: 1482 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1483 | ASTKGPSVFPLAP |
| | VH | | SEQ ID NO: 1484 | EVQLVESGGGLVQPGRSLRLSCAASGFT FDDYALHWVRQAPGKGLEWVSGIGWEDD MIDYADSVKGRFTISRDNAKNSLYLQMN SLRVEDTALYYCAGNSRGYGGLDVWGQG TTVTVSS |
| | CH | | SEQ ID NO: 1485 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Domain Name | Outer Variable Domain Name | Inner Variable Domain Name | Sequence Identifier | Sequence<br>12345678901234567890123456789 0 |
|---|---|---|---|---|
| DVD2646L | AB437VL | MSL10-AM2.2VL | SEQ ID NO: 1486 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PQSVLTQPPSASGTPGQRVTISCSGSSS NIGGNTVNWYQQLPGTAPKLLIYSNNQR PSGVPDRFSGSKSGTSASLAISGLQSED EADYYCAAWDDSLEGSYVFGGGTKLTVL G |
| | VL | | SEQ ID NO: 1487 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1488 | TVAAP |
| | VL | | SEQ ID NO: 1489 | QSVLTQPPSASGTPGQRVTISCSGSSSN IGGNTVNWYQQLPGTAPKLLIYSNNQRP SGVPDRFSGSKSGTSASLAISGLQSEDE ADYYCAAWDDSLEGSYVFGGGTKLTVLG |
| | CL | | SEQ ID NO: 1490 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2647H | AB437VH | MSL10-AM3.2VH | SEQ ID NO: 1491 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSGGGGSGGGGSEVQLVESGGGLVQ PGRSLRLSCAASGFTFDDYALHWVRQAP GKGLEWVSGIGWDEDMIDYADSVKGRFT ISRDNAKNSLYLQMNSLRVEDTALYYCA GNNRGYGGLDVWGQGTTVTVSS |
| | VH | | SEQ ID NO: 1492 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1493 | GGGGSGGGGS |
| | VH | | SEQ ID NO: 1494 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 1495 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890 |
|---|---|---|---|---|
| DVD2647L | AB437VL | MSL10-AM3.2VL | SEQ ID NO: 1496 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRGGSG GGGSGQSVLTQPPSASGTPGQRVTISCS GSWSNIGSNTVNWYQQLPGTAPKLLIYN NNQRPSGVPDRFSGSKSGTSASLAISGL QSEDEADYYCAAWDDSLSGEYVFGGGTK LTVLG |
| | VL | | SEQ ID NO: 1497 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1498 | GGSGGGGSG |
| | VL | | SEQ ID NO: 1499 | QSVLTQPPSASGTPGQRVTISCSGSWSN IGSNTVNWYQQLPGTAPKLLIYNNQRP SGVPDRFSGSKSGTSASLAISGLQSEDE ADYYCAAWDDSLSGEYVFGGGTKLTVLG |
| | CL | | SEQ ID NO: 1500 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2648H | AB437VH | MSL10-AM3.2VH | SEQ ID NO: 1501 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGIGWDEDMIDYADSVKGRFTISRD NAKNSLYLQMNSLRVEDTALYYCAGNNR GYGGLDVWGQGTTVTVSS |
| | VH | | SEQ ID NO: 1502 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1503 | ASTKGP |
| | VH | | SEQ ID NO: 1504 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 1505 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Name | Outer Variable Domain Name | Inner Variable Domain Name | Sequence Identifier | Sequence<br>12345678901234567890123456789 0 |
|---|---|---|---|---|
| DVD2648L | AB437VL | MSL10-AM3.2VL | SEQ ID NO: 1506 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PQSVLTQPPSASGTPGQRVTISCSGSWS NIGSNTVNWYQQLPGTAPKLLIYNNNQR PSGVPDRFSGSKSGTSASLAISGLQSED EADYYCAAWDDSLSGEYVFGGGTKLTVL G |
| | VL | | SEQ ID NO: 1507 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1508 | TVAAP |
| | VL | | SEQ ID NO: 1509 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 1510 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2649H | AB437VH | MSL10-AM3.2VH | SEQ ID NO: 1511 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGIGWDEDMIDYADSVKG RFTISRDNAKNSLYLQMNSLRVEDTALY YCAGNNRGYGGLDVWGQGTTVTVSS |
| | VH | | SEQ ID NO: 1512 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1513 | ASTKGPSVFPLAP |
| | VH | | SEQ ID NO: 1514 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 1515 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2649L | AB437VL | MSL10-AM3.2VL | SEQ ID NO: 1516 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PSVFIFPPQSVLTQPPSASGTPGQRVTI SCSGSWSNIGSNTVNWYQQLPGTAPKLL IYNNNQRPSGVPDRFSGSKSGTSASLAI SGLQSEDEADYYCAAWDDSLSGEYVFGG GTKLTVLG |
| VL | | | SEQ ID NO: 1517 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Linker | | | SEQ ID NO: 1518 | TVAAPSVFIFPP |
| VL | | | SEQ ID NO: 1519 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| CL | | | SEQ ID NO: 1520 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2650H | AB437VH | MSL10-AM3.2VH | SEQ ID NO: 1521 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPEVQLVESGGGLVQPGRS LRLSCAASGFTFDDYALHWVRQAPGKGL EWVSGIGWDEDMIDYADSVKGRFTISRD NAKNSLYLQMNSLRVEDTALYYCAGNNR GYGGLDVWGQGTTVTVSS |
| VH | | | SEQ ID NO: 1522 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| Linker | | | SEQ ID NO: 1523 | ASTKGP |
| VH | | | SEQ ID NO: 1524 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| CH | | | SEQ ID NO: 1525 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence<br>12345678901234567890123456789 0 |
|---|---|---|---|---|
| DVD2650L | AB437VL | MSL10-AM3.2VL | SEQ ID NO: 1526 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PSVFIFPPQSVLTQPPSASGTPGQRVTI SCSGSWSNIGSNTVNWYQQLPGTAPKLL IYNNNQRPSGVPDRFSGSKSGTSASLAI SGLQSEDEADYYCAAWDDSLSGEYVFGG GTKLTVLG |
| | VL | | SEQ ID NO: 1527 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1528 | TVAAPSVFIFPP |
| | VL | | SEQ ID NO: 1529 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 1530 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2651H | AB437VH | MSL10-AM3.2VH | SEQ ID NO: 1531 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPSVFPLAPEVQLVESGGG LVQPGRSLRLSCAASGFTFDDYALHWVR QAPGKGLEWVSGIGWDEDMIDYADSVKG RFTISRDNAKNSLYLQMNSLRVEDTALY YCAGNNRGYGGLDVWGQGTTVTVSS |
| | VH | | SEQ ID NO: 1532 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1533 | ASTKGPSVFPLAP |
| | VH | | SEQ ID NO: 1534 | EVQLVESGGGLVQPGRSLRLSCAASGFT FDDYALHWVRQAPGKGLEWVSGIGWDED MIDYADSVKGRFTISRDNAKNSLYLQMN SLRVEDTALYYCAGNNRGYGGLDVWGQG TTVTVSS |
| | CH | | SEQ ID NO: 1535 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Name | Outer Variable Domain Name | Inner Variable Domain Name | Sequence Identifier | Sequence<br>1234567890123456789012345 67890 |
|---|---|---|---|---|
| DVD2651L | AB437VL | MSL10-AM3.2VL | SEQ ID NO: 1536 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PQSVLTQPPSASGTPGQRVTISCSGSWS NIGSNTVNWYQQLPGTAPKLLIYNNNQR PSGVPDRFSGSKSGTSASLAISGLQSED EADYYCAAWDDSLSGEYVFGGGTKLTVL G |
| | VL | | SEQ ID NO: 1537 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Linker | | SEQ ID NO: 1538 | TVAAP |
| | VL | | SEQ ID NO: 1539 | QSVLTQPPSASGTPGQRVTISCSGSWSN IGSNTVNWYQQLPGTAPKLLIYNNNQRP SGVPDRFSGSKSGTSASLAISGLQSEDE ADYYCAAWDDSLSGEYVFGGGTKLTVLG |
| | CL | | SEQ ID NO: 1540 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2652H | AB437VH | MSL10-AM4.2VH | SEQ ID NO: 1541 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSGGGGSGGGGSEVQLVESGGGLVQ PGRSLRLSCAASGFTFEDYALHWVRQAP GKGLEWVSGIGWDDDMIDYADSVKGRFT ISRDNAKNSLYLQMNSLRVEDTALYYCA GNNRGYGGLDVWGQGTTVTVSS |
| | VH | | SEQ ID NO: 1542 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | Linker | | SEQ ID NO: 1543 | GGGGSGGGGS |
| | VH | | SEQ ID NO: 1544 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| | CH | | SEQ ID NO: 1545 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD2652L | AB437VL | MSL10-AM4.2VL | SEQ ID NO: 1546 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRGGSG GGGSGQSVLTQPPSASGTPGQRVTISCS GSSSNIGSNTVNWYQQLPGTAPKLLIYN NNQRPSGVPDRFSGSKSGTSASLAISGL QSEDEADYYCAAWDDSLDSYVFGGGTKL TVLG |
| VL | | | SEQ ID NO: 1547 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Linker | | | SEQ ID NO: 1548 | GGSGGGGSG |
| VL | | | SEQ ID NO: 1549 | QSVLTQPPSASGTPGQRVTISCSGSSSN IGSNTVNWYQQLPGTAPKLLIYNNQRP SGVPDRFSGSKSGTSASLAISGLQSEDE ADYYCAAWDDSLDSYVFGGGTKLTVLG |
| CL | | | SEQ ID NO: 1550 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2653H | AB437VH | MSL10-AM4.2VH | SEQ ID NO: 1551 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPEVQLVESGGGLVQPGRS LRLSCAASGFTFEDYALHWVRQAPGKGL EWVSGIGWDDDMIDYADSVKGRFTISRD NAKNSLYLQMNSLRVEDTALYYCAGNNR GYGGLDVWGQGTTVTVSS |
| VH | | | SEQ ID NO: 1552 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| Linker | | | SEQ ID NO: 1553 | ASTKGP |
| VH | | | SEQ ID NO: 1554 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 1555 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 123456789012345678901234567890 |
|---|---|---|---|---|
| DVD2653L | AB437VL | MSL10-AM4.2VL | SEQ ID NO: 1556 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PQSVLTQPPSASGTPGQRVTISCSGSSS NIGSNTVNWYQQLPGTAPKLLIYNNNQR PSGVPDRFSGSKSGTSASLAISGLQSED EADYYCAAWDDSLDSYVFGGGTKLTVLG |
| VL | | | SEQ ID NO: 1557 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Linker | | | SEQ ID NO: 1558 | TVAAP |
| VL | | | SEQ ID NO: 1559 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 1560 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2654H | AB437VH | MSL10-AM4.2VH | SEQ ID NO: 1561 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPSVFPLAPEVQLVESGGG LVQPGRSLRLSCAASGFTFEDYALHWVR QAPGKGLEWVSGIGWDDDMIDYADSVKG RFTISRDNAKNSLYLQMNSLRVEDTALY YCAGNNRGYGGLDVWGQGTTVTVSS |
| VH | | | SEQ ID NO: 1562 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| Linker | | | SEQ ID NO: 1563 | ASTKGPSVFPLAP |
| VH | | | SEQ ID NO: 1564 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 1565 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2654L | AB437VL | MSL10-AM4.2VL | SEQ ID NO: 1566 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PSVFIFPPQSVLTQPPSASGTPGQRVTI SCSGSSSNIGSNTVNWYQQLPGTAPKLL IYNNNQRPSGVPDRFSGSKSGTSASLAI SGLQSEDEADYYCAAWDDSLDSYVFGGG TKLTVLG |
| VL | | | SEQ ID NO: 1567 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Linker | | | SEQ ID NO: 1568 | TVAAPSVFIFPP |
| VL | | | SEQ ID NO: 1569 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 1570 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2655H | AB437VH | MSL10-AM4.2VH | SEQ ID NO: 1571 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPEVQLVESGGGLVQPGRS LRLSCAASGFTFEDYALHWVRQAPGKGL EWVSGIGWDDDMIDYADSVKGRFTISRD NAKNSLYLQMNSLRVEDTALYYCAGNNR GYGGLDVWGQGTTVTVSS |
| VH | | | SEQ ID NO: 1572 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| Linker | | | SEQ ID NO: 1573 | ASTKGP |
| VH | | | SEQ ID NO: 1574 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 1575 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2655L | AB437VL | MSL10-AM4.2VL | SEQ ID NO: 1576 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PSVFIFPPQSVLTQPPSASGTPGQRVTI SCSGSSSNIGSNTVNWYQQLPGTAPKLL IYNNNQRPSGVPDRFSGSKSGTSASLAI SGLQSEDEADYYCAAWDDSLDSYVFGGG TKLTVLG |
| VL | | | SEQ ID NO: 1577 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Linker | | | SEQ ID NO: 1578 | TVAAPSVFIFPP |
| VL | | | SEQ ID NO: 1579 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 1580 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2656H | AB437VH | MSL10-AM4.2VH | SEQ ID NO: 1581 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSSASTKGPSVFPLAPEVQLVESGGG LVQPGRSLRLSCAASGFTFEDYALHWVR QAPGKGLEWVSGIGWDDDMIDYADSVKG RFTISRDNAKNSLYLQMNSLRVEDTALY YCAGNNRGYGGLDVWGQGTTVTVSS |
| VH | | | SEQ ID NO: 1582 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| Linker | | | SEQ ID NO: 1583 | ASTKGPSVFPLAP |
| VH | | | SEQ ID NO: 1584 | EVQLVESGGGLVQPGRSLRLSCAASGFT FEDYALHWVRQAPGKGLEWVSGIGWDDD MIDYADSVKGRFTISRDNAKNSLYLQMN SLRVEDTALYYCAGNNRGYGGLDVWGQG TTVTVSS |
| CH | | | SEQ ID NO: 1585 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQGGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2656L | AB437VL | MSL10-AM4.2VL | SEQ ID NO: 1586 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKRTVAA PQSVLTQPPSASGTPGQRVTISCSGSSS NIGSNTVNWYQQLPGTAPKLLIYNNNQR PSGVPDRFSGSKSGTSASLAISGLQSED EADYYCAAWDDSLDSYVFGGGTKLTVLG |
| VL | | | SEQ ID NO: 1587 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Linker | | | SEQ ID NO: 1588 | TVAAP |
| VL | | | SEQ ID NO: 1589 | QSVLTQPPSASGTPGQRVTISCSGSSSN IGSNTVNWYQQLPGTAPKLLIYNNNQRP SGVPDRFSGSKSGTSASLAISGLQSEDE ADYYCAAWDDSLDSYVFGGGTKLTVLG |
| CL | | | SEQ ID NO: 1590 | QPKAAPSVTLFPPSSEELQANKATLVCL ISDFYPGAVTVAWKADSSPVKAGVETTT PSKQSNNKYAASSYLSLTPEQWKSHRSY SCQVTHEGSTVEKTVAPTECS |
| DVD2657H | MSL10-AM1.2VH | AB436VH | SEQ ID NO: 1591 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSGGGGSGGGGSEVQLVESGGGL VQPGGSLRLSCAASGFTFSNYGVTWVRQ APGKGLEWVSMIWADGSTHYASSVKGRF TISRDNSKNTLYLQMNSLRAEDTAVYYC AREWQHGPVAYWGQGTLVTVSS |
| VH | | | SEQ ID NO: 1592 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| Linker | | | SEQ ID NO: 1593 | GGGGSGGGGS |
| VH | | | SEQ ID NO: 1594 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| CH | | | SEQ ID NO: 1595 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence |
|---|---|---|---|---|
| DVD2657L | MSL10-AM1.2VL | AB436VL | SEQ ID NO: 1596 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGG GSGGGGSGDIQMTQSPSSLSASVGDRVT ITCRASQLVSSAVAWYQQKPGKAPKLLI YWASARHTGVPSRFSGSGSGTDFTLTIS SLQPEDFATYYCQQHYKTPFTFGQGTKL EIKR |
| | VL | | SEQ ID NO: 1597 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | Linker | | SEQ ID NO: 1598 | GGSGGGGSG |
| | VL | | SEQ ID NO: 1599 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Ck | | SEQ ID NO: 1600 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD2658H | MSL10-AM1.2VH | AB436VH | SEQ ID NO: 1601 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSASTKGPEVQLVESGGGLVQPG GSLRLSCAASGFTFSNYGVTWVRQAPGK GLEWVSMIWADGSTHYASSVKGRFTISR DNSKNTLYLQMNSLRAEDTAVYYCAREW QHGPVAYWGQGTLVTVSS |
| | VH | | SEQ ID NO: 1602 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | Linker | | SEQ ID NO: 1603 | ASTKGP |
| | VH | | SEQ ID NO: 1604 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| | CH | | SEQ ID NO: 1605 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2658L | MSL10-AM1.2VL | AB436VL | SEQ ID NO: 1606 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGQ PKAAPDIQMTQSPSSLSASVGDRVTITC RASQLVSSAVAWYQQKPGKAPKLLIYWA SARHTGVPSRFSGSGSGTDFTLTISSLQ PEDFATYYCQQHYKTPFTFGQGTKLEIK R |
| VL | | | SEQ ID NO: 1607 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| Linker | | | SEQ ID NO: 1608 | QPKAAP |
| VL | | | SEQ ID NO: 1609 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Ck | | | SEQ ID NO: 1610 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD2659H | MSL10-AM1.2VH | AB436VH | SEQ ID NO: 1611 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSASTKGPSVFPLAPEVQLVESG GGLVQPGGSLRLSCAASGFTFSNYGVTW VRQAPGKGLEWVSMIWADGSTHYASSVK GRFTISRDNSKNTLYLQMNSLRAEDTAV YYCAREWQHGPVAYWGQGTLVTVSS |
| VH | | | SEQ ID NO: 1612 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| Linker | | | SEQ ID NO: 1613 | ASTKGPSVFPLAP |
| VH | | | SEQ ID NO: 1614 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| CH | | | SEQ ID NO: 1615 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 1234567890123456789012345678901234567890 |
|---|---|---|---|---|
| DVD2659L | MSL10-AM1.2VL | AB436VL | SEQ ID NO: 1616 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGQ PKAAPSVTLFPPDIQMTQSPSSLSASVG DRVTITCRASQLVSSAVAWYQQKPGKAP KLLIYWASARHTGVPSRFSGSGSGTDFT LTISSLQPEDFATYYCQQHYKTPFTFGQ GTKLEIKR |
| VL | | | SEQ ID NO: 1617 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| Linker | | | SEQ ID NO: 1618 | QPKAAPSVTLFPP |
| VL | | | SEQ ID NO: 1619 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| Ck | | | SEQ ID NO: 1620 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD2660H | MSL10-AM1.2VH | AB436VH | SEQ ID NO: 1621 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSASTKGPEVQLVESGGGLVQPG GSLRLSCAASGFTFSNYGVTWVRQAPGK GLEWVSMIWADGSTHYASSVKGRFTISR DNSKNTLYLQMNSLRAEDTAVYYCAREW QHGPVAYWGQGTLVTVSS |
| VH | | | SEQ ID NO: 1622 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| Linker | | | SEQ ID NO: 1623 | ASTKGP |
| VH | | | SEQ ID NO: 1624 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| CH | | | SEQ ID NO: 1625 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence 12345678901234567890123 4567890 |
|---|---|---|---|---|
| DVD2660L | MSL10-AM1.2VL | AB436VL | SEQ ID NO: 1626 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGQPKAAPSVTLFPPDIQMTQSPSSLSASVG DRVTITCRASQLVSSAVAWYQQKPGKAP KLLIYWASARHTGVPSRFSGSGSGTDFT LTISSLQPEDFATYYCQQHYKTPFTFGQ GTKLEIKR |
| | VL | | SEQ ID NO: 1627 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | Linker | | SEQ ID NO: 1628 | QPKAAPSVTLFPP |
| | VL | | SEQ ID NO: 1629 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Cκ | | SEQ ID NO: 1630 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD2661H | MSL10-AM1.2VH | AB436VH | SEQ ID NO: 1631 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSASTKGPSVFPLAPEVQLVESG GGLVQPGGSLRLSCAASGFTFSNYGVTW VRQAPGKGLEWVSMIWADGSTHYASSVK GRFTISRDNSKNTLYLQMNSLRAEDTAV YYCAREWQHGPVAYWGQGTLVTVSS |
| | VH | | SEQ ID NO: 1632 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | Linker | | SEQ ID NO: 1633 | ASTKGPSVFPLAP |
| | VH | | SEQ ID NO: 1634 | EVQLVESGGGLVQPGGSLRLSCAASGFT FSNYGVTWVRQAPGKGLEWVSMIWADGS THYASSVKGRFTISRDNSKNTLYLQMNS LRAEDTAVYYCAREWQHGPVAYWGQGTL VTVSS |
| | CH | | SEQ ID NO: 1635 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of
TNF/SOST DVD-Binding Proteins

| DVD-Binding Protein Variable Domain Name | Outer Variable Domain Name | Inner Variable Domain Name | Sequence Identifier | Sequence<br>12345678901234567890123456789 0 |
|---|---|---|---|---|
| DVD2661L | MSL10-AM1.2VL | AB436VL | SEQ ID NO: 1636 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGQPKAAPDIQMTQSPSSLSASVGDRVTITC RASQLVSSAVAWYQQKPGKAPKLLIYWA SARHTGVPSRFSGSGSGTDFTLTISSLQ PEDFATYYCQQHYKTPFTFGQGTKLEIK R |
| | VL | | SEQ ID NO: 1637 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | Linker | | SEQ ID NO: 1638 | QPKAAP |
| | VL | | SEQ ID NO: 1639 | DIQMTQSPSSLSASVGDRVTITCRASQL VSSAVAWYQQKPGKAPKLLIYWASARHT GVPSRFSGSGSGTDFTLTISSLQPEDFA TYYCQQHYKTPFTFGQGTKLEIKR |
| | Ck | | SEQ ID NO: 1640 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD2662H | MSL10-AM1.2VH | AB437VH | SEQ ID NO: 1641 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSGGGGSGGGGSEVQLVESGGGL VQPGGSLRLSCAASGFTFSNYGVEWVRQ APGKGLEWVSGIWADGSTHYADTVKSRF TISRDNSKNTLYLQMNSLRAEDTAVYYC AREWQHGPVAYWGQGTLVTVSS |
| | VH | | SEQ ID NO: 1642 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | Linker | | SEQ ID NO: 1643 | GGGGSGGGGS |
| | VH | | SEQ ID NO: 1644 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | CH | | SEQ ID NO: 1645 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD2662L | MSL10-AM1.2VL | AB437VL | SEQ ID NO: 1646 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGG GSGGGGSGDIQMTQSPSSLSASVGDRVT ITCKASQLVSSAVAWYQQKPGKAPKLLI YWASTLHTGVPSRFSGSGSGTDFTLTIS SLQPEDFATYYCQQHYRTPFTFGQGTKL EIKR |
| VL | | | SEQ ID NO: 1647 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| Linker | | | SEQ ID NO: 1648 | GGSGGGGSG |
| VL | | | SEQ ID NO: 1649 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Ck | | | SEQ ID NO: 1650 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD2663H | MSL10-AM1.2VH | AB437VH | SEQ ID NO: 1651 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSASTKGPEVQLVESGGGLVQPG GSLRLSCAASGFTFSNYGVEWVRQAPGK GLEWVSGIWADGSTHYADTVKSRFTISR DNSKNTLYLQMNSLRAEDTAVYYCAREW QHGPVAYWGQGTLVTVSS |
| VH | | | SEQ ID NO: 1652 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| Linker | | | SEQ ID NO: 1653 | ASTKGP |
| VH | | | SEQ ID NO: 1654 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| CH | | | SEQ ID NO: 1655 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2663L | MSL10-AM1.2VL | AB437VL | SEQ ID NO: 1656 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGQ PKAAPDIQMTQSPSSLSASVGDRVTITC KASQLVSSAVAWYQQKPGKAPKLLIYWA STLHTGVPSRFSGSGSGTDFTLTISSLQ PEDFATYYCQQHYRTPFTFGQGTKLEIK R |
| | VL | | SEQ ID NO: 1657 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| | Linker | | SEQ ID NO: 1658 | QPKAAP |
| | VL | | SEQ ID NO: 1659 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| | Ck | | SEQ ID NO: 1660 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD2664H | MSL10-AM1.2VH | AB437VH | SEQ ID NO: 1661 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSASTKGPSVFPLAPEVQLVESG GGLVQPGGSLRLSCAASGFTFSNYGVEW VRQAPGKGLEWVSGIWADGSTHYADTVK SRFTISRDNSKNTLYLQMNSLRAEDTAV YYCAREWQHGPVAYWGQGTLVTVSS |
| | VH | | SEQ ID NO: 1662 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| | Linker | | SEQ ID NO: 1663 | ASTKGPSVFPLAP |
| | VH | | SEQ ID NO: 1664 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| | CH | | SEQ ID NO: 1665 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2664L | MSL10-AM1.2VL | AB437VL | SEQ ID NO: 1666 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGQ PKAAPSVTLFPPDIQMTQSPSSLSASVG DRVTITCKASQLVSSAVAWYQQKPGKAP KLLIYWASTLHTGVPSRFSGSGSGTDFT LTISSLQPEDFATYYCQQHYRTPFTFGQ GTKLEIKR |
| VL | | | SEQ ID NO: 1667 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| Linker | | | SEQ ID NO: 1668 | QPKAAPSVTLFPP |
| VL | | | SEQ ID NO: 1669 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Ck | | | SEQ ID NO: 1670 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD2665H | MSL10-AM1.2VH | AB437VH | SEQ ID NO: 1671 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSASTKGPEVQLVESGGGLVQPG GSLRLSCAASGFTFSNYGVEWVRQAPGK GLEWVSGIWADGSTHYADTVKSRFTISR DNSKNTLYLQMNSLRAEDTAVYYCAREW QHGPVAYWGQGTLVTVSS |
| VH | | | SEQ ID NO: 1672 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| Linker | | | SEQ ID NO: 1673 | ASTKGP |
| VH | | | SEQ ID NO: 1674 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| CH | | | SEQ ID NO: 1675 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456789 0 |
|---|---|---|---|---|
| DVD2665L | MSL10-AM1.2VL | AB437VL | SEQ ID NO: 1676 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGQ PKAAPSVTLFPPDIQMTQSPSSLSASVG DRVTITCKASQLVSSAVAWYQQKPGKAP KLLIYWASTLHTGVPSRFSGSGSGTDFT LTISSLQPEDFATYYCQQHYRTPFTFGQ GTKLEIKR |
| VL | | | SEQ ID NO: 1677 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| Linker | | | SEQ ID NO: 1678 | QPKAAPSVTLFPP |
| VL | | | SEQ ID NO: 1679 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Ck | | | SEQ ID NO: 1680 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |
| DVD2666H | MSL10-AM1.2VH | AB437VH | SEQ ID NO: 1681 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSSASTKGPSVFPLAPEVQLVESG GGLVQPGGSLRLSCAASGFTFSNYGVEW VRQAPGKGLEWVSGIWADGSTHYADTVK SRFTISRDNSKNTLYLQMNSLRAEDTAV YYCAREWQHGPVAYWGQGTLVTVSS |
| VH | | | SEQ ID NO: 1682 | EVQLVESGGGLVQPGRSLRLSCAASGFT FDDYALHWVRQAPGKGLEWVSGINWEGD DIDYADSVKGRFTISRDNAKNSLYLQMN SLRVEDTALYYCAGNSRGYGGLDVWGQG TTVTVSS |
| Linker | | | SEQ ID NO: 1683 | ASTKGPSVFPLAP |
| VH | | | SEQ ID NO: 1684 | EVQLVESGGGLVQPGGSLRLSCAASGFT FSNYGVEWVRQAPGKGLEWVSGIWADGS THYADTVKSRFTISRDNSKNTLYLQMNS LRAEDTAVYYCAREWQHGPVAYWGQGTL VTVSS |
| CH | | | SEQ ID NO: 1685 | ASTKGPSVFPLAPSSKSTSGGTAALGCL VKDYFPEPVTVSWNSGALTSGVHTFPAV LQSSGLYSLSSVVTVPSSSLGTQTYICN VNHKPSNTKVDKKVEPKSCDKTHTCPPC PAPEAAGGPSVFLFPPKPKDTLMISRTP EVTCVVVDVSHEDPEVKFNWYVDGVEVH NAKTKPREEQYNSTYRVVSVLTVLHQDW LNGKEYKCKVSNKALPAPIEKTISKAKG QPREPQVYTLPPSREEMTKNQVSLTCLV KGFYPSDIAVEWESNGQPENNYKTTPPV LDSDGSFFLYSKLTVDKSRWQQGNVFSC SVMHEALHNHYTQKSLSLSPGK |

TABLE 18-continued

Sequences Of Variable And Constant Regions Of TNF/SOST DVD-Binding Proteins

| DVD-Binding Protein Variable Domain Name | Outer Variable Domain Name | Inner Variable Domain Name | Sequence Identifier | Sequence 12345678901234567890123456 7890 |
|---|---|---|---|---|
| DVD2666L | MSL10-AM1.2VL | AB437VL | SEQ ID NO: 1686 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLGQ PKAAPDIQMTQSPSSLSASVGDRVTITC KASQLVSSAVAWYQQKPGKAPKLLIYWA STLHTGVPSRFSGSGSGTDFTLTISSLQ PEDFATYYCQQHYRTPFTFGQGTKLEIK R |
| VL | | | SEQ ID NO: 1687 | QSVLTQPPSASGTPGQRVTISCSGSSSN IGRNTVNWYQQLPGTAPKLLIYSNNQRP SGVPDRFSGSKSGTSASLAISGLQSEDE ADYYCAAWDDNLESYVFGGGTKLTVLG |
| Linker | | | SEQ ID NO: 1688 | QPKAAP |
| VL | | | SEQ ID NO: 1689 | DIQMTQSPSSLSASVGDRVTITCKASQL VSSAVAWYQQKPGKAPKLLIYWASTLHT GVPSRFSGSGSGTDFTLTISSLQPEDFA TYYCQQHYRTPFTFGQGTKLEIKR |
| Ck | | | SEQ ID NO: 1690 | TVAAPSVFIFPPSDEQLKSGTASVVCLL NNFYPREAKVQWKVDNALQSGNSQESVT EQDSKDSTYSLSSTLTLSKADYEKHKVY ACEVTHQGLSSPVTKSFNRGEC |

Example 3.4

Binding Affinity of DVD-Igs

Figures 1, 7A:
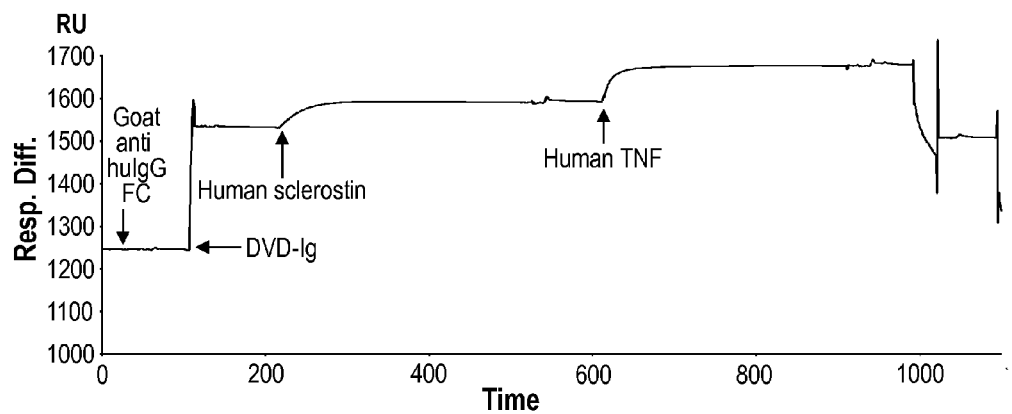
Figures 2, 7A:
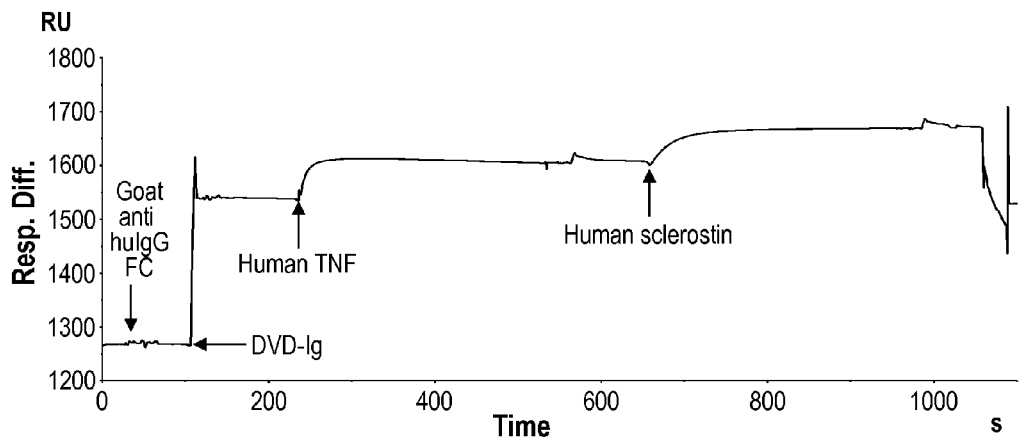
Figures 1, 7B:
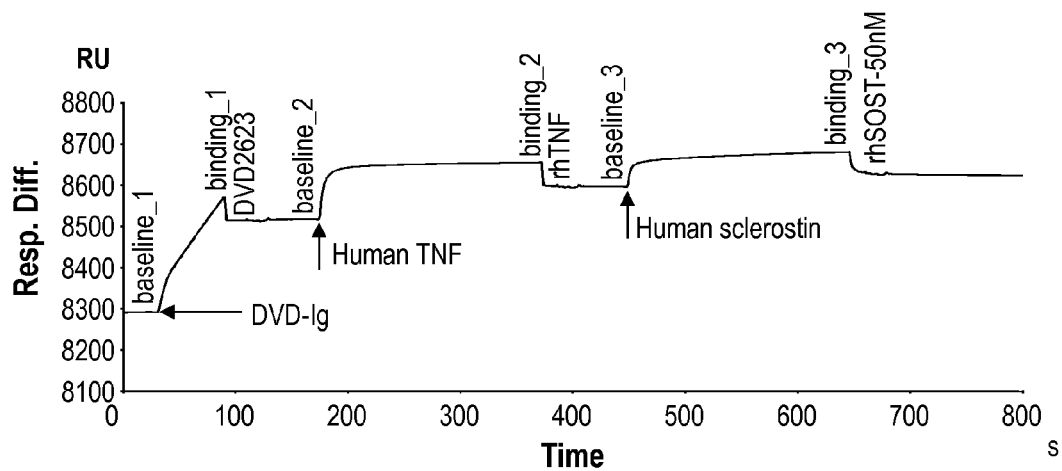
Figures 2, 7B:
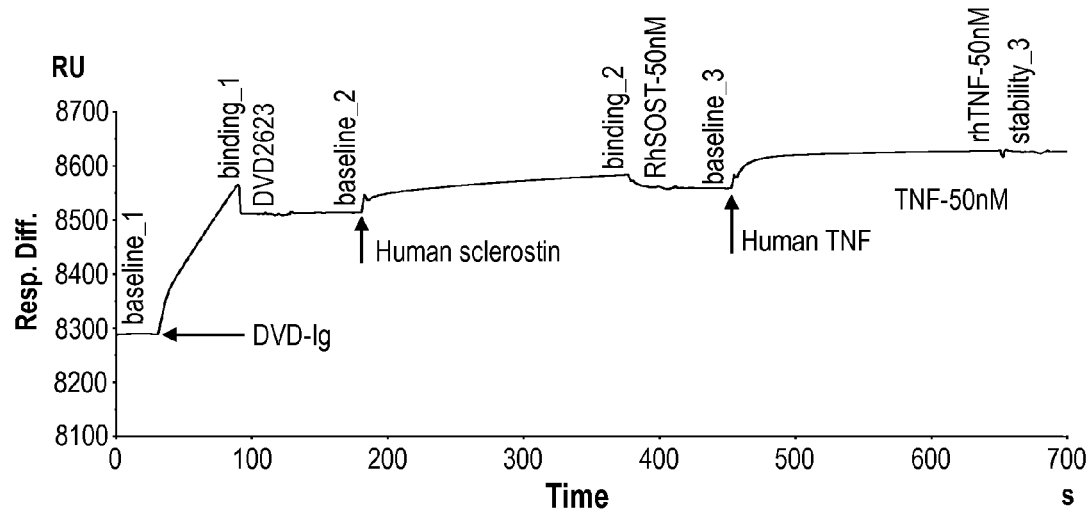

For measuring simultaneous binding of two antigens to DVD, DVD-Igs were captured onto a goat anti huIgG FC at 5 μl/min for 1 min. The sclerostin at 50 nM was then injected over the captured surface at 5 μl/min for 10 min, to saturate DVD binding, followed by coinjection of 50 nM TNF at 5 μl/min for 10 min to check for TNF binding to the DVD, which has sclerostin already bound to it. The surfaces were regenerated with 10s injection of 50 mM NaOH followed by 10s injection of 10 mM Glycine pH1.5 at a flow rate of 100 μl/min. The same experiment was repeated in the reverse sequence of antigens where TNF was injected first followed by coinjection of sclerostin. Exemplary binding profiles are provided for MAK199-1-GS-AE10-6AM7 DVD-Ig (FIG. 7A) and DVD2623 (FIG. 7B).

The affinity and kinetic parameters of the DVD-Ig binding to SOST and TNF are provided in Table 19 below. The detailed description of the method used is provided in section

TABLE 19

Affinity and kinetic parameters of the DVD-Ig binding to sclerostin and TNF

| name | antigen | $k_a$, M$^{-1}$s$^{-1}$ | $k_d$, s$^{-1}$ | $K_D$, M |
|---|---|---|---|---|
| DVD2603 | hu sclerostin | 1.40E+05 | <1E−06 | <7.1E−12 |
| DVD2658 | hu sclerostin | 2.70E+05 | <1E−06 | <3.7E−12 |
| DVD2657 | hu sclerostin | 2.80E+05 | 4.90E−06 | 1.70E−11 |
| DVD2605 | hu sclerostin | 5.70E+04 | 3.70E−05 | 6.40E−10 |
| DVD2606 | hu sclerostin | 9.90E+04 | 6.50E−05 | 6.60E−10 |
| DVD2645 | hu sclerostin | 8.50E+04 | 6.30E−05 | 7.50E−10 |
| DVD2643 | hu sclerostin | 7.60E+04 | 6.30E−05 | 8.30E−10 |
| DVD2642 | hu sclerostin | 6.00E+04 | 6.00E−05 | 1.00E−09 |
| DVD2646 | hu sclerostin | 1.10E+05 | 1.20E−04 | 1.10E−09 |
| DVD2628 | hu sclerostin | 6.40E+04 | 9.30E−05 | 1.50E−09 |
| DVD2631 | hu sclerostin | 7.90E+04 | 1.40E−04 | 1.80E−09 |
| DVD2650 | hu sclerostin | 5.10E+04 | 1.30E−04 | 2.60E−09 |
| DVD2651 | hu sclerostin | 4.30E+04 | 1.20E−04 | 2.70E−09 |
| DVD2648 | hu sclerostin | 8.30E+04 | 3.30E−04 | 4.00E−09 |
| DVD2647 | hu sclerostin | 4.60E+04 | 2.10E−04 | 4.60E−09 |
| DVD2607 | hu sclerostin | 5.4E+04 | 1.9E−04 | 3.5E−09 |
| DVD2608 | hu sclerostin | 7.4E+04 | 1.5E−04 | 2.1E−09 |
| DVD2610 | hu sclerostin | 5.3E+04 | 9.2E−05 | 1.7E−09 |
| DVD2611 | hu sclerostin | 5.7E+04 | 7.1E−05 | 1.2E−09 |

TABLE 19-continued

Affinity and kinetic parameters of the DVD-Ig binding to sclerostin and TNF

| name | antigen | $k_a$, M$^{-1}$s$^{-1}$ | $k_d$, s$^{-1}$ | $K_D$, M |
|---|---|---|---|---|
| DVD2623 | hu sclerostin | 7.5E+04 | <1E−06 | <1.3E−11 |
| DVD2627 | hu sclerostin | 4.5E+04 | 4.3E−05 | 9.6E−10 |
| DVD2630 | hu sclerostin | 3.7E+04 | 4.8E−05 | 1.3E−09 |
| DVD2603 | cyno sclerostin | 1.70E+05 | 1.00E−04 | 6.00E−10 |
| DVD2658 | cyno sclerostin | 5.00E+05 | 3.00E−05 | 6.10E−11 |
| DVD2657 | cyno sclerostin | 3.90E+05 | 5.00E−05 | 1.30E−10 |
| DVD2605 | cyno sclerostin | 8.90E+04 | 9.60E−06 | 1.10E−10 |
| DVD2606 | cyno sclerostin | 2.00E+05 | 2.00E−05 | 9.60E−11 |
| DVD2645 | cyno sclerostin | 1.30E+05 | 2.80E−05 | 2.10E−10 |
| DVD2643 | cyno sclerostin | 1.70E+05 | <1E−06 | <5.9E−12 |
| DVD2642 | cyno sclerostin | 1.50E+05 | <1E−06 | <6.7E−12 |
| DVD2646 | cyno sclerostin | 2.30E+05 | 6.60E−05 | 2.90E−10 |
| DVD2628 | cyno sclerostin | 9.00E+04 | 2.80E−04 | 3.10E−09 |
| DVD2631 | cyno sclerostin | 1.10E+05 | 2.40E−04 | 2.30E−09 |
| DVD2650 | cyno sclerostin | 1.10E+05 | 1.50E−04 | 1.40E−09 |
| DVD2651 | cyno sclerostin | 7.80E+04 | 2.00E−04 | 2.60E−09 |
| DVD2648 | cyno sclerostin | 9.30E+04 | 1.20E−04 | 1.30E−09 |
| DVD2647 | cyno sclerostin | 7.30E+04 | 2.30E−04 | 3.10E−09 |
| DVD2607 | cyno sclerostin | 9.90E+04 | 1.40E−04 | 1.50E−09 |
| DVD2608 | cyno sclerostin | 1.20E+05 | 2.10E−04 | 1.50E−09 |
| DVD2610 | cyno sclerostin | 7.30E+04 | 8.60E−05 | 1.20E−09 |
| DVD2611 | cyno sclerostin | 1.10E+05 | 1.70E−04 | 1.50E−09 |
| DVD2623 | cyno sclerostin | 9.90E+04 | <1e−6 | <1.0e−11 |
| DVD2627 | cyno sclerostin | 5.40E+04 | 1.40E−04 | 2.60E−09 |
| DVD2630 | cyno sclerostin | 4.60E+04 | 1.20E−05 | 2.50E−10 |
| DVD2603 | huTNF | 1.10E+06 | 1.10E−04 | 1.10E−10 |
| DVD2658 | huTNF | 1.00E+05 | 5.30E−05 | 5.20E−10 |
| DVD2657 | huTNF | 1.70E+05 | 1.20E−04 | 7.20E−10 |
| DVD2605 | huTNF | 1.30E+06 | 5.20E−05 | 4.10E−11 |
| DVD2606 | huTNF | 1.20E+06 | 4.80E−05 | 4.00E−11 |
| DVD2645 | huTNF | 2.20E+06 | 3.30E−05 | 1.50E−11 |
| DVD2643 | huTNF | 2.40E+06 | 3.50E−05 | 1.50E−11 |
| DVD2642 | huTNF | 2.70E+06 | 3.30E−05 | 1.20E−11 |
| DVD2646 | huTNF | 2.40E+06 | 3.00E−05 | 1.20E−11 |
| DVD2628 | huTNF | 4.80E+06 | 6.30E−05 | 1.30E−11 |
| DVD2650 | huTNF | 1.80E+06 | 3.50E−05 | 2.00E−11 |
| DVD2651 | huTNF | 2.30E+06 | 3.80E−05 | 1.70E−11 |
| DVD2648 | huTNF | 1.80E+06 | 5.60E−05 | 3.10E−11 |
| DVD2647 | huTNF | 2.40E+06 | 3.40E−05 | 1.40E−11 |
| DVD2603 | huTNF | 4.20E+06 | 3.00E−05 | 7.00E−12 |
| DVD2607 | huTNF | 1.10E+05 | 4.70E−05 | 4.20E−10 |
| DVD2608 | huTNF | 7.00E+04 | 1.50E−04 | 2.20E−09 |
| DVD2610 | huTNF | 8.70E+04 | 3.30E−05 | 3.80E−10 |
| DVD2611 | huTNF | 9.00E+04 | 2.40E−05 | 2.70E−10 |
| DVD2623 | huTNF | 2.10E+05 | 4.70E−05 | 2.30E−10 |
| DVD2627 | huTNF | 1.90E+05 | 3.40E−05 | 1.80E−10 |
| DVD2630 | huTNF | 2.00E+05 | 2.90E−05 | 1.40E−10 |
| MAK195-21-SS-AE106-AM7 | hu sclerostin | 6.8E+05 | <1E−06 | <1.5E−12 |
| MAK195-21-GS-AE106-AM8 | hu sclerostin | 2.2E+06 | 7.9E−06 | 3.6E−12 |
| MAK195-21-GS-AE106-AM3 | hu sclerostin | 2.1E+06 | 1.7E−05 | 8.2E−12 |
| MAK195-21-GS-AE106-AM7 | hu sclerostin | 2.0E+06 | 2.0E−05 | 1.0E−11 |
| AE10-6AM7-GS-MAK195-21 | hu sclerostin | 6.8E+06 | <1E−06 | <1.5E−13 |
| D2E7-GS-AE10-6AM7 | hu sclerostin | 1.2E+06 | <1E−06 | <8.3E−13 |
| diD2E7ss-GS-AE10-6AM7 | hu sclerostin | 1.1E+06 | 2.1E−07 | 1.9E−13 |
| MAK199-1-GS-AM10-6 AM7 | hu sclerostin | 5.9E+06 | 2.3E−06 | 3.9E−13 |
| MAK199-1-GS-AE10-6AM7QL | hu sclerostin | 6.1E+06 | <1e−06 | <1.6E−13 |
| MAK199-1-GS-AE10-6AM7QL | cyno sclerostin | 9.9E+06 | <1e−6 | <1e−13 |
| MAK199-1-GS-AE10-6AM7 | cyno sclerostin | 9.3E+06 | <1e−6 | <1.1E−13 |
| MAK199-1-SS-AE10-6AM7 | hu sclerostin | 1.6E+05 | 8.3E−06 | 5.2E−11 |
| MAK195-21-SS-AE10-6AM7 | huTNF | 7.3E+06 | 6.0E−05 | 8.2E−12 |
| MAK195-21-GS-AE10-6AM7 | huTNF | 4.3E+06 | 4.8E−05 | 1.1E−11 |
| MAK195-21-GS-AE10-6AM3 | huTNF | 4.2E+06 | 4.7E−05 | 1.1E−11 |
| MAK195-21-GS-AE10-6AM8 | huTNF | 4.0E+06 | 4.8E−05 | 1.2E−11 |
| AE10-6AM7-GS-MAK195-21 | huTNF | 1.0E+06 | 4.8E−05 | 4.7E−11 |
| D2E7GSAE106AM7 | huTNF | 5.8E+06 | 4.3E−05 | 7.3E−12 |
| diD2E7ssGSAE106 AM7 | huTNF | 2.4E+06 | 6.2E−05 | 2.6E−11 |
| MAK199-1GSAM10-6 AM7 | huTNF | 2.1E+06 | 5.8E−05 | 2.7E−11 |
| MAK199-1GSAE106AM7QL | huTNF | 4.2E+06 | 3.0E−05 | 7.0E−12 |
| MAK199-1-SS-AE106AM7 | huTNF | 2.6E+06 | 4.4E−05 | 1.7E−11 |

Example 3.5

TopFlash Wnt Pathway Sclerostin Neutralization Assay

The assay that demonstrates neutralization of sclerostin inhibition of Wnt pathway was performed as described above. DVD2603, DVD2605, DVD2606, DVD2607, DVD2608, DVD2610, DVD2611, DVD2623, DVD2627, DVD2628, DVD2630, DVD2631, DVD2642, DVD2643, DVD2645, DVD2646, DVD2647, DVD2648, DVD2650, DVD2651, DVD2657, DVD2658 inhibited recombinant human sclerostin with IC50 of 12-24.4 nM. MAK199-1-GS-AE10-6 AM7, MAK199-1-SS-AE10-6 AM7, MAK199-1-GS-AE10-6 AM7 QL, MAK195/21-GS-AE10-6 AM3, MAK195/21-GS-AE10-6 AMB, diD2E7ss-GS-AE10-6 AM7, D2E7-GS-AE10-6 AM7, AE10-6 AM7-GS MAK195/21 inhibited recombinant human sclerostin with IC50 of 1.7-6.6 nM and recombinant cynomolgus monkey sclerostin with IC50 of 2-9.1 nM. MAK199-1-GS-AE10-6 AM7, MAK199-1-SS-AE10-6 AM7, MAK195/21-GS-AE10-6 AM7, MAK195/21-SS-AE10-6 AM7, MAK195/21-GS-AE10-6 AM3, MAK195/21-GS-AE10-6 AMB, diD2E7ss-GS-AE10-6 AM7, D2E7-GS-AE10-6 AM7, AE10-6 AM7-GS MAK195/21 inhibited recombinant mouse sclerostin with IC50 of 9.4-27.6 nM.

Example 3.6

Neutralization of Recombinant TNF-α

TNF-a neutralizing potency of the DVD-Igs was evaluated in L929 Neutralization of recombinant TNF assay. Semiconfluent L929 mouse fibroblast cells (ATCC, cat # CCL-1™) were grown and harvested using 0.25% tryspin (Gibco, cat #25200-056). The cells were washed with PBS (Gibco, cat #14190-144), counted and resuspended at $5\times10^5$ cells/mL in complete assay media consisting of RPMI 1640 (Gibco, cat #21870), 10% Fetal Bovine Serum (Hyclone, cat # SH30070.03), 1% L-Glutamine (Gibco, cat #25030), 1% Sodium Pyruvate (Gibco, cat #113670), 1% Non-Essential Aminos (Gibco, cat #11140), 50 units/mL Penicillin/50 µg/mL Streptomycin (Gibco, cat #15140), 55 µM of 2-BME (Mercaptoethanol-Gibco, cat #21985), and a 2× concentration of 2 µg/mL actinomycin D (Sigma, cat # A1410). The cells were seeded in a 96-well plate (Costar, cat #3599) at a volume of 100 µL corresponding to $5\times10^4$ cells/well. Monoclonal antibodies (mAb), DVD-Igs™ and control IgG were diluted to a 4× concentration in assay media and serial dilutions were performed. Recombinant TNF-α was diluted to a 4× concentration of 600 pg/mL in assay media. All antibody samples (mAbs or DVD-Igs™) were pre-incubated with recombinant TNF-α at a 1:1 volume ratio and allowed to incubate for 1 hour at 37° C., 5% $CO_2$. In some instances, recombinant human sclerostin was also added to the pre-incubation step. For these conditions, 8× dilutions of DVD-Ig™, recombinant TNF-α (1200 ng/mL) and human sclerostin (400 nM) and 50 µL of complete assay media were pre-incubated for 1 hour at 37° C., 5% $CO_2$.

One hundred µL of the mAb or DVD-Ig™/recombinant TNF-α solution was added to the plated cells at 100 µL for a 1× final concentration of 150 pg/mL of recombinant TNF-α, mAb or DVD-Ig™ and 1 µg/mL actinomycin D. In cases where human sclersotin was added, 100 µL of the DVD-Ig™/recombinant TNF-α/human sclerostin/media solution was added to the plated cells at 100 µL for a 1× final concentration of 150 pg/mL of recombinant TNF-α, mAb or DVD-Ig™, human sclersotin (50 nM) and 1 µg/mL actinomycin D. Plates were incubated overnight (16-24 hours) at 37° C., 5% $CO_2$. To quantitate viability, 100 µL was removed from the wells and 10 µL of WST-1 reagent (Roche, cat #11644807001) was added. Plates were incubated at 37° C., 5% $CO_2$ for an additional 3-5 hours and read on a Spectromax 190 ELISA plate reader at OD 420-600 nm. Neutralization data was plotted using GraphPad Prism. Reported $IC_{50}$ values were calculated using GraphPad Prism sigmoidal curve dose software and are provided in Table 20 below.

TABLE 20

Neutralization of Recombinant TNF-α

| | Human TNFa IC50, pM | Rhesus/cynoTNFa IC50, pM |
|---|---|---|
| DVD2607 | 19.5 | 10.5 |
| DVD2608 | 64 | 43 |
| DVD2610 | 9.5 | 11 |
| DVD2611 | 27.5 | 16.5 |
| DVD2630 | 9.5 | 6 |
| DVD2627 | 8.5 | 9 |
| DVD2623 | 20.5 | 28.5 |
| DVD2657 | 1128 | ND |
| DVD2658 | 1746 | ND |
| MAK195-21-GS-AE10-6 AM7 | 19.5 | ND |
| MAK195-21-GS-AE10-6 AM3 | 44.9 | ND |
| MAK195-21-GS-AE10-6 AM8 | 28.2 | ND |
| MAK195-21-SS-AE10-6 AM7 | 27.7 | ND |
| MAK199-1-GS-AE10-6 AM7 | 67.7 | 42 |
| MAK199-1-SS-AE10-6 AM7 | 58.1 | 56.9 |
| diD2E7ss-GS-AE10-6 AM7 | 46.3 | 35.2 |
| D2E7-GS-AE10-6AM7 | 38.8 | 28.2 |
| AE10-6 AM7-GS-MAK195-21 | 1233 | >2000 |
| DVD2580 | 8 | ND |
| DVD2581 | 11 | ND |
| DVD2577 | 2 | ND |
| DVD2578 | 6 | ND |

In order to demonstrate that binding of sclerostin to the DVD-Igs does not affect TNF-a neutralizing properties of the molecules, DVD-Igs were first pre-incubated with 50 nM SOST at least for 30 min and then L929 assay was performed with 50 nM SOST throught the experiment. The results of this experiment are provided are in Table 21 below.

TABLE 21

Example of comparison of TNF-a neutralization with and without 50 nM SOST

| | Human TNFa IC50, pM with 50 nM SOST | Human TNFa IC50, pM without 50 nM SOST |
|---|---|---|
| MAK199-1-GS-AE10-6 AM7 | 36 | 25 |
| MAK199-1-GS-AE10-6 AM7 QL | 32 | 33 |
| DVD2623 | 46 | 56 |

Example 4

Pharmacokinetic (PK) Analysis for TNF/Sclerostin DVD Ig

Male Sprague-Dawley JVC rats weighing approximately 280 g received a single dose in the jugular vein with the DVD-Ig or the parental antibody at 5 mg/kg. Serum samples were collected from the tail vein at 15 minutes, 4 and 24 hours, and 2, 3, 7, 10, 14, 21 and 28 days after dosing. Serum samples were frozen at −80° C. until analysis.

Male CD1 mice weighing approximately 28 g received a single dose via tail vein with the DVD-Ig or the parental antibody at 5 mg/kg. Whole blood samples were collected from the tail vein at 1 and 24 hours, and 4, 7, 10, 14 and 21 days after dosing. Samples were frozen at −80° C. until analysis.

Bioanalysis of samples was performed using an MSD assay. Briefly, strepatavidin plates were coated with biotinylated human antigen and incubated overnight. Plates were blocked, and diluted serum samples (final serum concentration was 1%) were added to the wells, and Sulfo-tag-labeled goat anti-human IgG was used for detection. Pharmacokinetic parameters for each animal were calculated with WinNonlin software Version 5.2.1 by non-compartmental analysis using linear trapezoidal fit. The PK parameters obtained in mouse and rat are provided in Tables 22 and 23 below, respectively.

TABLE 22

PK Parameters in Mouse

| Compound | $T_{1/2}$ (day) | $V_{ss}$ (mL/kg) | Cl (mL/hr/kg) |
|---|---|---|---|
| MAK195/24-GS-MSL10-AM2 | 15 | 114 | 0.21 |
| DVD2623 | 14.1 | 257 | 0.56 |
| MAK199-1-GS-AE10-6 AM7 | 15.3 | 84 | 0.16 |
| MAK199-1-GS-AE10-6 AM7 QL | 12.3 | 105 | 0.26 |

TABLE 23

PK Parameters in Rat

| Compound | $T_{1/2}$ (day) | $V_{ss}$ (mL/kg) | Cl (mL/hr/kg) |
|---|---|---|---|
| MAK195/24-GS-MSL10-AM2 | 13.3 | 68 | 0.16 |
| DVD2603 | 8.7 | 80 | 0.3 |
| D2E7-GS-MSL10 | 11.5 | 67 | 0.21 |
| DVD2578 | 10.2 | 79 | 0.24 |
| DVD2580 | 7.4 | 65 | 0.26 |
| DVD2581 | 10.6 | 84 | 0.26 |
| MAK199-1-GS-AE10-6 AM7 | 6.8 | 58 | 0.34 |
| MAK199-1-GS-AE10-6 AM7 QL | 5.6 | 58 | 0.33 |

Example 5

Evaluation of DVD Domains for In Vivo Efficacy

The anti-sclerostin domains of the DVDs were evaluated for in vivo efficacy using an acute PD model. All DVD-Igs tested induced increased bone formation based on the increase in the bone biomarker, PINP. Naïve DBA/1 male mice, greater than 10 weeks of age, were treated with a single dose of DVD-Ig, i.p. Three days post injection, serum was collected via cardiac puncture and tested for levels of the bone formation biomarker, PINP, by ELISA. All DVD-Igs tested induced increased bone formation based on the increases in serum levels of the bone biomarker, PINP. See Table 24.

TABLE 24

Percent Increase in PINP

| PR# | % increase (30 mg/kg) |
|---|---|
| MAK195-21-GS-AE10-6 AM7 | 31 |
| DVD2623 | 24 |
| MAK195/21-GS-AE10-6AM8 | 57 |
| MAK199-1-SS-AE10-6 AM7 | 52 |
| MAK199-1-GS-AE10-6 AM7 | 38 |

The anti-TNF domains of the DVDs were evaluated for in vivo efficacy in a human TNF/D-Galactosamine lethality model in which naïve C57Bl/6 female mice were treated with the DVD, i.p. Eighteen hours post dose, animals were challenged with 0.5 μg/mouse TNF and 20 mg/mouse D-Galactosamine intraperitoneally and animals were monitored twice daily for survival. TNF domains in all DVD-Igs tested were active and protected mice from TNF induced lethality. See Table 25.

TABLE 25

| PR# | Percent Survival | | | |
|---|---|---|---|---|
| | 1.0 mg/kg | 03. mg/kg | 0.1 mg/kg | 0.03 mg/kg |
| MAK199-1-SS-AE10-6 AM7 | 100 | 100 | 70 | 0 |
| MAK195/21-SS-AE10-6AM7 | 90 | 80 | 60 | 40 |
| MAK199-1-GS-AE10-6 AM7 | 100 | 100 | 90 | 20 |
| DVD2623 | 100 | 90 | 30 | 10 |
| DVD2603 | 100 | 100 | 50 | 30 |

Figure 2A:
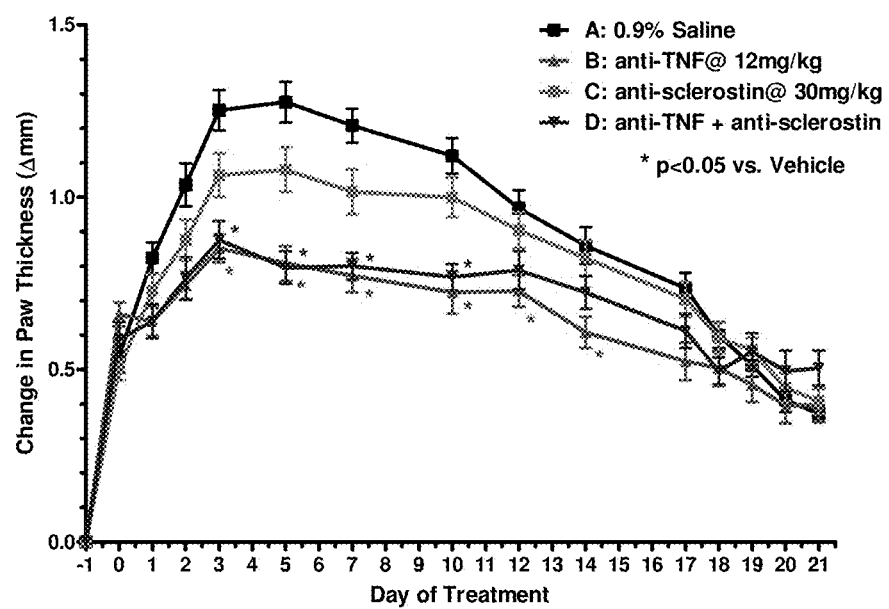
FIG. 2A shows the change in paw thickness when dosed with anti-mouse TNF mAb, anti-sclerostin mAb, or a combination of both anti-mouse TNF mAb and anti-sclerostin mAb.
Figure 2B:
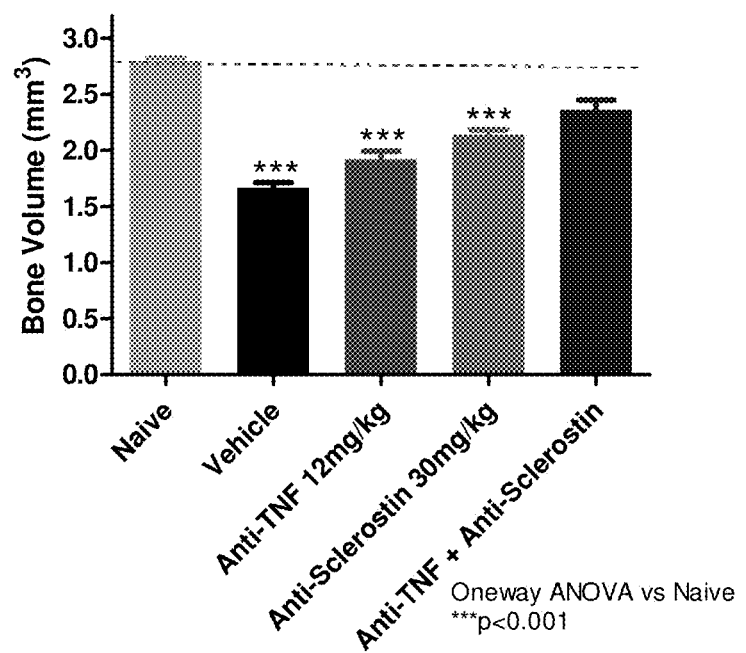
FIG. 2B shows the arthritic ankle bone volume when dosed with anti-mouse TNF mAb, anti-sclerostin mAb, or a combination of both anti-mouse TNF mAb and anti-sclerostin mAb.
Figure 2C:
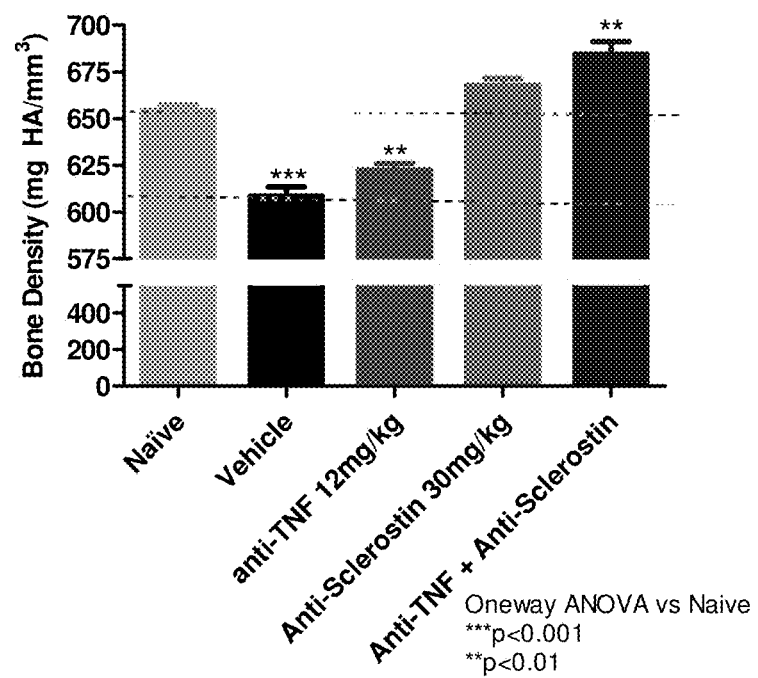
FIG. 2C shows the bone density of trabecular bone in the lumbar spine (L5) when dosed with anti-mouse TNF mAb, anti-sclerostin mAb, or a combination of both anti-mouse TNF mAb and anti-sclerostin mAb.
Figure 3:
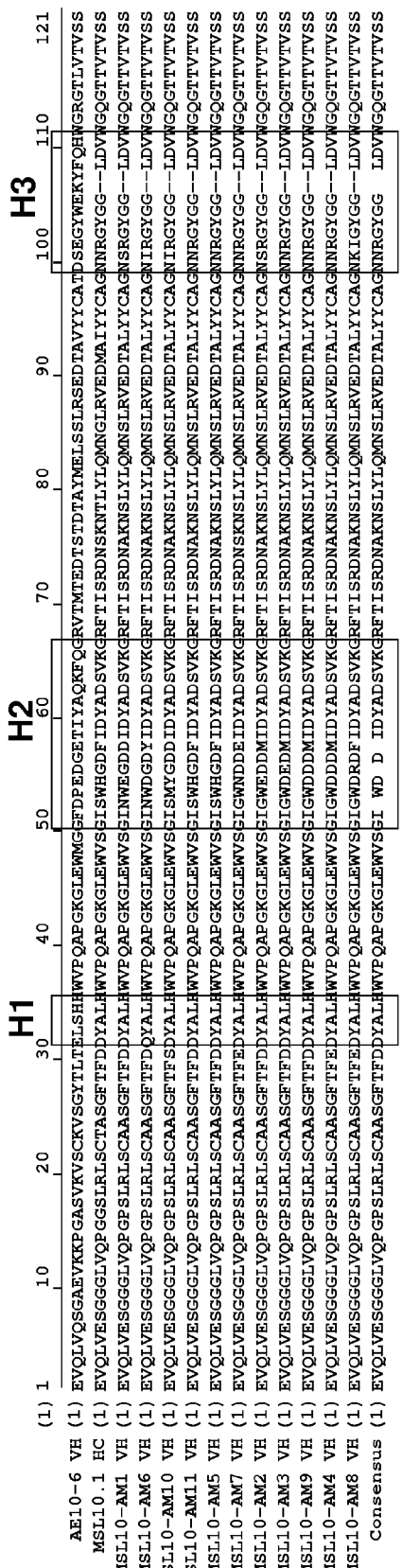
FIG. 3 demonstrates the alignment of anti-SOST antibodies (SEQ ID NOS 2066-2093).
Figure 3:
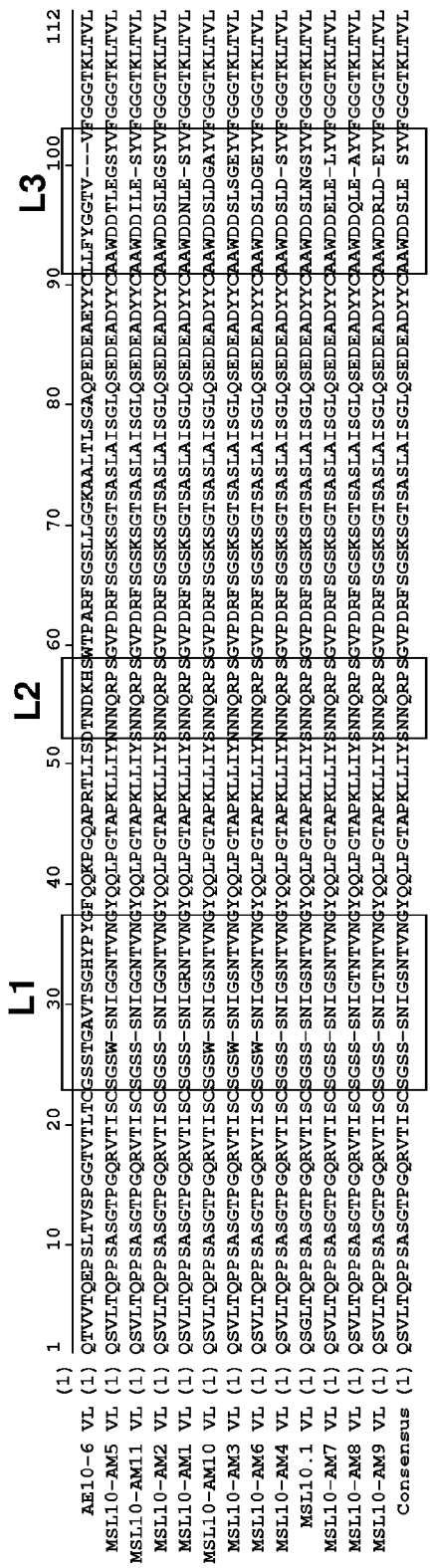

Efficacy of Anti-TNF, Anti-SOST, and Combined Anti-TNF and Anti-SOST Therapies in an Induced Arthritis Mouse Model Anti-TNF, anti-SOST, and combined anti-TNF and anti-SOST therapies were evaluated for their efficacy in preventing arthritis in a mouse model of induced arthritis. Mice were immunized with collagen at day 0, boosted with an intraperitoneal injection of Zymosan on day 21, and selected for clinical signs of arthritis from days 24-28. The mice were then treated starting at the day of enrollment with an anti-TNF therapeutic (anti-TNF, 12 mg/kg, subcutaneous injection, twice per week), an anti-sclerostin therapeutic (30 mg/kg, subcutaneous injection, twice per week), or the two therapeutics combined. Mice were evaluated changes in paw thickness over a period of 20 days, and on day 44-48, serum and bones were collected for endpoint analysis. As shown in FIG. 2A, mice treated with either the anti-TNF or the combined therapies exhibited less paw swelling than the control group treated with 0.9% saline. In addition, combined treatment with anti-TNF and anti-sclerostin therapies maintained or increased bone thickness in both the ankle and spine, respectively, as measured by micro-CT (FIGS. 2B and 2C).

Figure 4A:
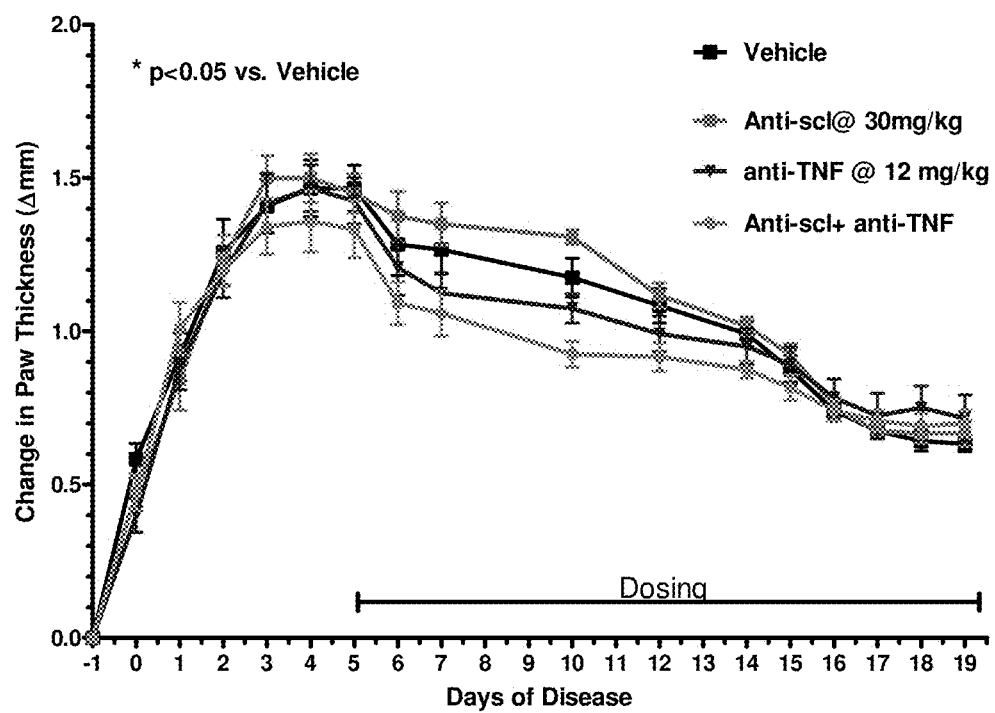
FIG. 4A shows the change in paw thickness when dosed with anti-mouse TNF mAb, anti-sclerostin mAb, or a combination of both anti-mouse TNF mAb and anti-sclerostin mAb.
Figure 4C:
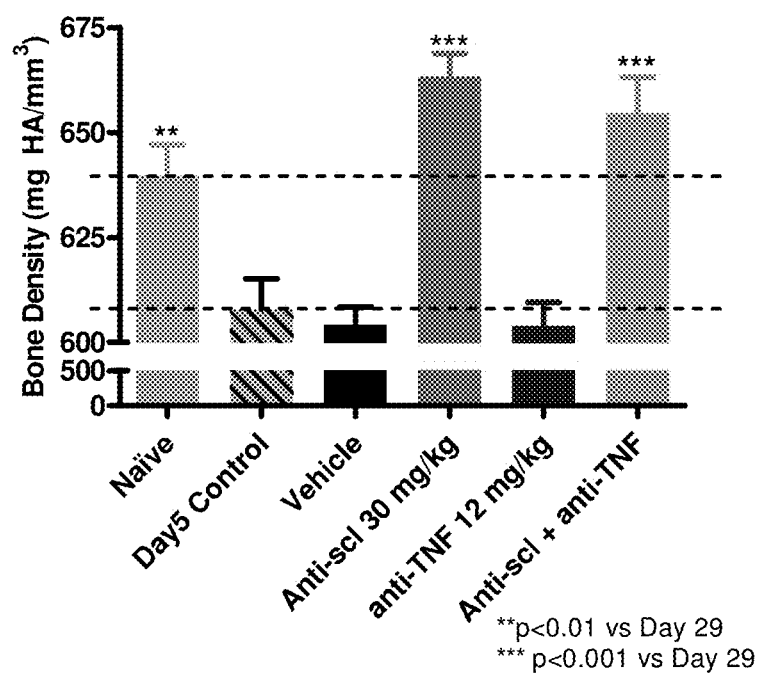
FIG. 4C shows the bone density of trabecular bone in the lumbar spine (L5) when dosed with anti-mouse TNF mAb, anti-sclerostin mAb, or a combination of both anti-mouse TNF mAb and anti-sclerostin mAb.

Combined neutralization of TNF and SOST was tested in a late therapeutic mouse collagen induced arthritis (CIA) model in which therapy began five days after the onset of inflammation, a timepoint at which moderate bone loss has occurred. DBA/1 mice were immunized with collagen on day 0, and boosted with zymosan on day 21. From day 24-28 mice were enrolled in the study based on first clinical signs of arthritis. Five days after enrollment, mice were dosed with 12 mg/kg of an anti-mouse TNF mAb, 30 mg/kg of an anti-sclerostin mAb, or a combination of both mAbs twice weekly for two weeks. Inflammation was monitored via paw swelling using calipers. Micro CT analysis of ankles and spines was used to evaluate changes in bone volume/density at study termination. A group of immunized mice was sacrificed on day 5 after the first signs of inflammation and the amount of bone lost at this timepoint was assessed using micro-computed tomography (μCT). As demonstrated in FIG. 4a) treatment with anti-TNF treatment is ineffective at preventing inflammation when treatment starts 5 days after the onset of disease. Treatment with either anti-TNF or anti-sclerostin mAbs alone did not prevent bone loss from the arthritic ankle, but the combination of both mAbs protected from further bone loss at this site (FIG. 4b). In contrast, while TNF inhibition did not protect skeletal bone, bone was restored to levels seen in naïve animals in the spine of animals treated with anti-sclerostin mAb, either alone or in combination with anti-TNF mAb (FIG. 4c)

Figure 5A:
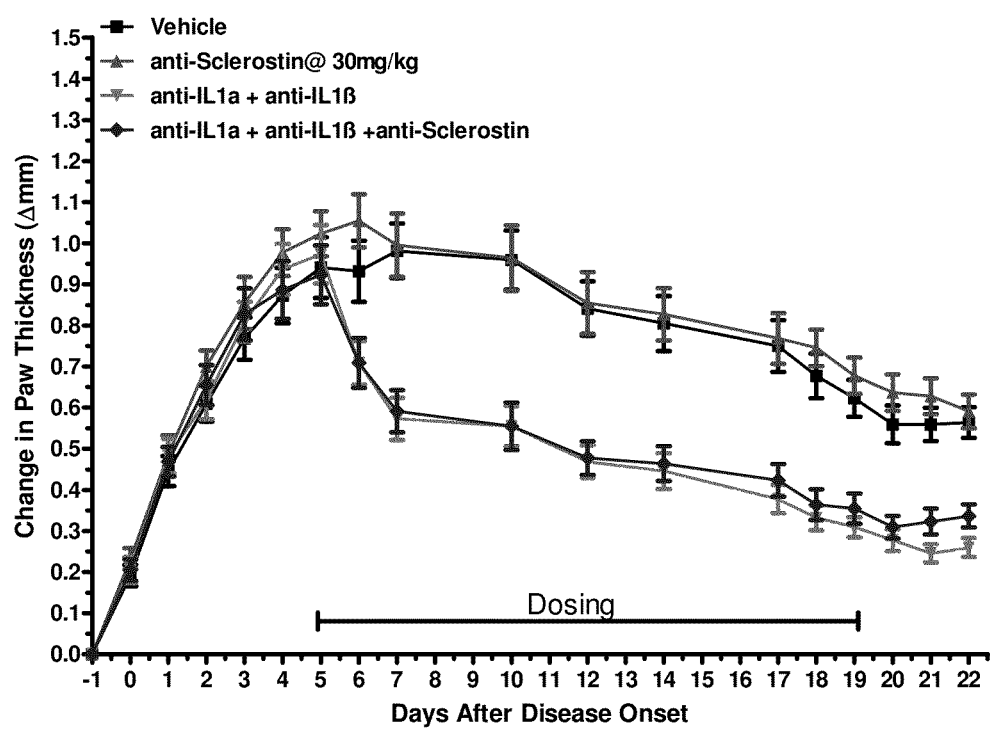
FIG. 5A shows the change in paw thickness when dosed with an anti-IL1α therapeutic and an anti-IL1β therapeutic, anti-sclerostin, or a combination of an anti-IL1α therapeutic and an anti-IL1β therapeutic and anti-sclerostin.
Figure 5C:
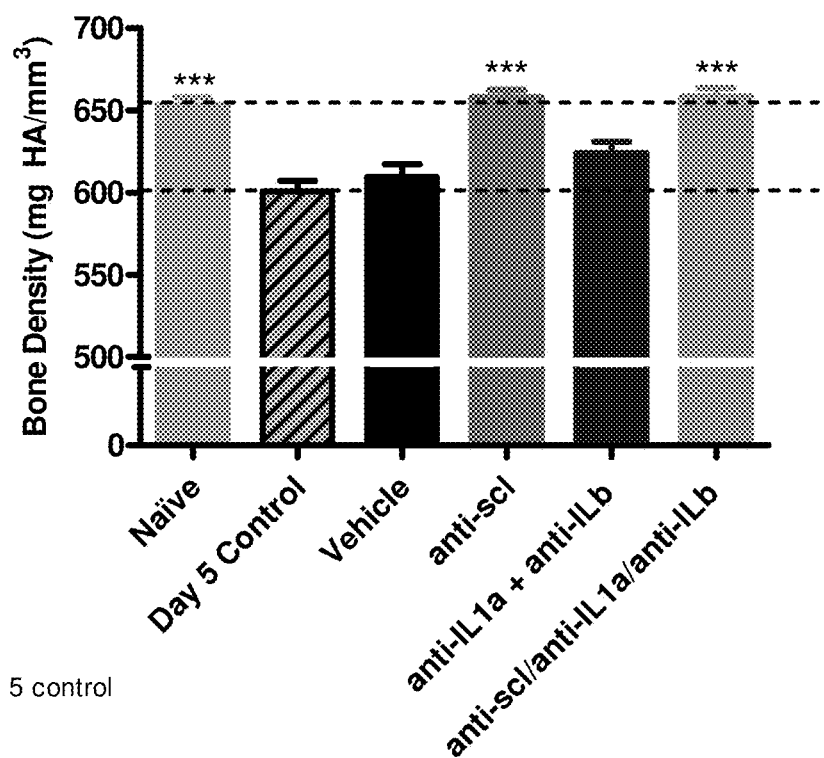
FIG. 5C shows the bone density of trabecular bone in the lumbar spine (L5) when dosed with an anti-IL1α therapeutic and an anti-IL1β therapeutic, anti-sclerostin, or a combination of an anti-IL1α therapeutic and an anti-IL1β therapeutic and anti-sclerostin.
Figure 6A:
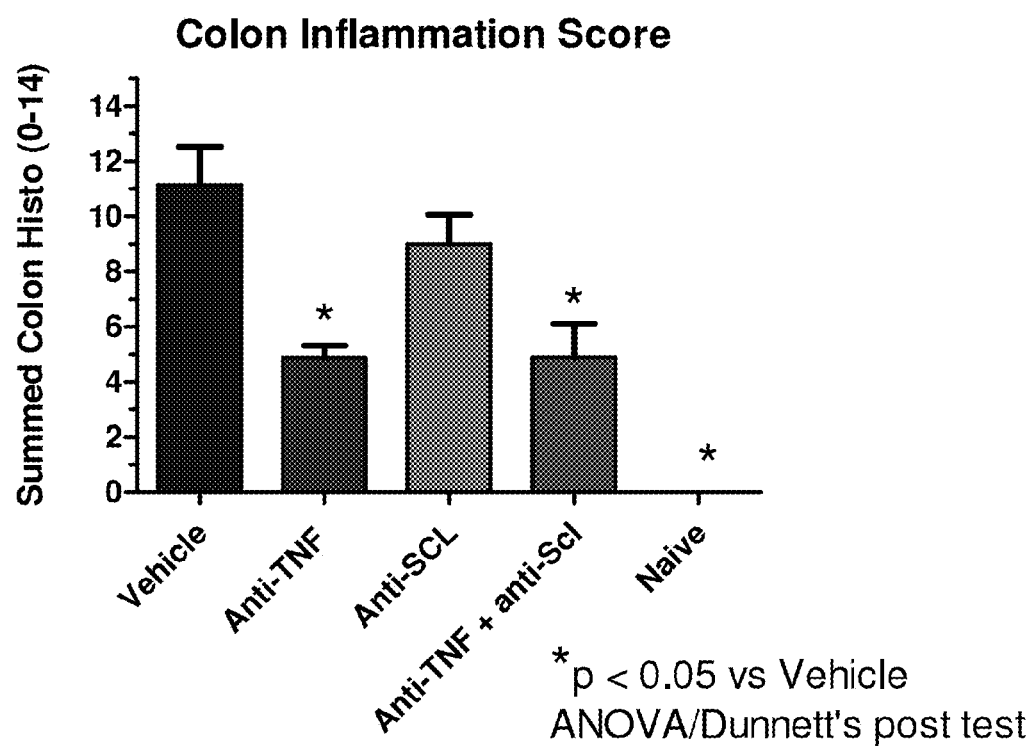
FIG. 6A shows the colon inflammation score when mice are dosed with anti-TNF mAb, anti-sclerostin mAb, or a combination of anti-TNF mAb and anti-sclerostin mAb.
Figure 6B:
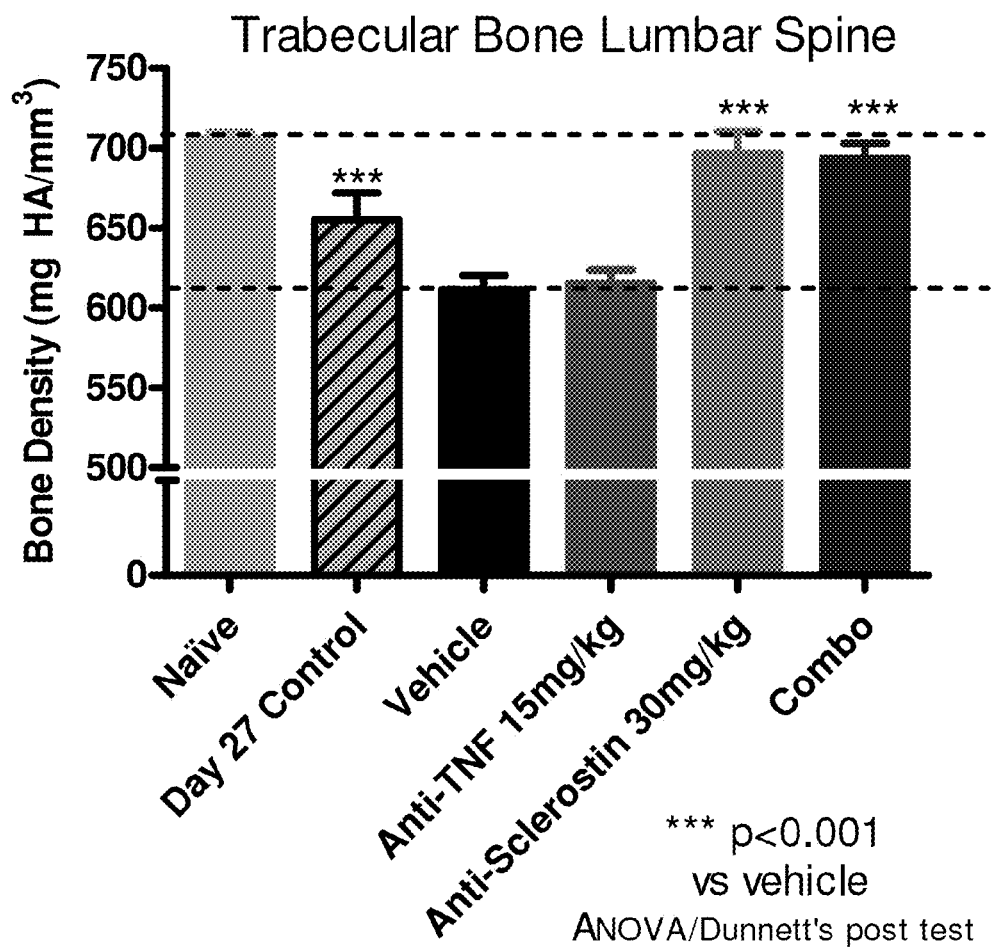
FIG. 6B shows the bone density of trabecular bone in the lumbar spine (L5) when mice are dosed with anti-TNF mAb, anti-sclerostin mAb, or a combination of anti-TNF mAb and anti-sclerostin mAb.

Since TNF inhibition is ineffective at controlling inflammation in the mouse CIA model, an alternative anti-inflammatory mechanism was used to test the ability of sclerostin inhibition to restore bone in the arthritic joint. Combined IL-1a and IL-1b inhibition blocks inflammation when dosing begins five days after the onset of inflammation so a study was done in which mice were immunized with collagen at day 0, boosted with an intraperitoneal injection of Zymosan on day 21, and selected for clinical signs of arthritis from days 24-28. The mice were treated twice weekly starting five days after the onset of inflammation with anti-IL1α therapeutic (9 mg/kg, ip) and anti-IL1β (4.5 mg/kg, ip), anti-sclerostin (30 mg/kg, ip), or a combination of all three mAbs. Paw swelling was monitored during the 20 days of treatment, after which serum and bones were collected for endpoint analysis. The anti-inflammatory activity achieved with the combined inhibition of IL-1a and IL-1b is demonstrated in FIG. 5a. Micro CT analysis of the arthritic ankle showed that blockade of inflammation combined with sclerostin inhibition allowed restoration of bone in the arthritic ankle (FIG. 5b). Analysis of trabecular bone of the lumbar spines of these animals showed that sclerostin inhibition was able to restore skeletal bone alone or in combination with inflammation blockade (FIG. 5c).

Example 6

Efficacy of Anti-TNF, Anti-Sclerostin, and Combined Anti-TNF and Anti-sclerostin Therapies in a Mouse Model of Crohn's Disease Skeletal bone loss is a common co-morbidity in patients with Crohn's disease. We tested anti-sclerostin mAb, anti-TNF mAb, and the combination of both Abs in a mouse model of Crohns disease and measured changes in trabecular bone in the lumbar spine.

Splenocytes from female BALB/c mice (Taconic) were collected by mechanical disruption and enriched for $CD4^+$ cells using a negative selection magnetic bead kit (StemCell). The purified $CD4^+$ cells were stained with anti-GITR (glucocorticoid induced TNF family receptor) labeled with fluorescein (R&D Systems). Cells were analyzed by FACS (MoFlow Legacy) and the lowest 40% GITR-staining cells were collected. Post sorting analysis showed the population to be $CD4^+GITR^-$ with 95-98% purity. Cells were washed, resuspended and $5 \times 10^5$ cells were injected i.p. into female CB-17 scid mice (Taconic). Recipient mice were monitored 2-3 times/week for body weight, presence of loose or bloody stool, rectal prolapse, and general condition. A cohort of animals was sacrificed on Day 27 (day of treatment initiation) for histological analysis of colons and μCT examination of spines to determine baseline disease. Treatment consisted of twice weekly injections of vehicle (PBS), anti-TNF (15 mg/kg ip), anti-sclerostin (30 mg/kg ip), or both anti-TNF and anti-sclerostin, and continued until the study was terminated on Day 57 post cell injection. Animals were sacrificed; serum was collected and stored at −20° C. until used for determination of antibody levels. Colons were collected, flushed with PBS to remove fecal material, weighed and measured, placed in histology cassettes using the swiss roll technique, and stored in 10% formalin until processing. Following paraffin embedding, sections were stained with hemotoxylin and eosin, and scored for the presence of inflammation, crypt damage, mucosal ulcers, and extent of disease. There were 8 or 9 animals per group Animals losing greater than 20% of initial body weight were euthanized in accordance with IACUC guidelines. Additionally, spines were collected and trabecular bone in the L5 vertebrae was analyzed using μCT. Anti-TNF alone or in combination with anti-sclerostin mAb inhibited intestinal inflammation while anti-sclerostin mAb did not (FIG. 5a). In contrast, anti-sclerostin mAb treatment, alone or in combination with anti-TNF was able to restore bone lost in the lumbar spine to levels seen in a naïve animal (FIG. 5b).

Incorporation by Reference

Techniques well known in the field of molecular biology, drug delivery, immunology, molecular biology and cell biology are incorporated by reference in their entirety. These techniques include, but are not limited to, techniques described in the following publications: Ausubel et al. (eds.), Current Protocols in Molecular Biology, John Wiley & Sons, NY (1993); Ausubel, F. M. et al. eds., Short Protocols In Molecular Biology (4th Ed. 1999) John Wiley & Sons, NY. (ISBN 0-471-32938-X). Controlled Drug Bioavailability Drug Product Design and Performance, Smolen and Ball (eds.), Wiley, New York (1984); Giege, R. and Ducruix, A. Barrett, Crystallization of Nucleic Acids and Proteins, a Practical Approach, 2nd ed., pp. 20 1-16, Oxford University Press, New York, N.Y., (1999); Goodson, in Medical Applications of Controlled Release, vol. 2, pp. 115-138 (1984); Hammerling, et al., in: Monoclonal Antibodies and T-Cell Hybridomas 563-681 (Elsevier, N.Y., 1981; Harlow et al., Antibodies: A Laboratory Manual, (Cold Spring Harbor Laboratory Press, 2nd ed. 1988); Kabat et al., Sequences of Proteins of Immunological Interest (National Institutes of Health, Bethesda, Md. (1987) and (1991); Kabat, E. A., et al. (1991) Sequences of Proteins of Immunological Interest, Fifth Edition, U.S. Department of Health and Human Services, NIH Publication No. 91-3242; Kontermann and Dubel eds., Antibody Engineering (2001) Springer-Verlag. New York. 790 pp. (ISBN 3-540-41354-5); Kriegler, Gene Transfer and Expression, A Laboratory Manual, Stockton Press, NY (1990); Lu and Weiner eds., Cloning and Expression Vectors for Gene Function Analysis (2001) BioTechniques Press. Westborough, Mass. 298 pp. (ISBN 1-881299-21-X), Medical Applications of Controlled Release, Langer and Wise (eds.), CRC Pres., Boca Raton, Fla. (1974); Old, R. W. & S. B. Primrose, Principles of Gene Manipulation: An Introduction To Genetic Engineering (3d Ed. 1985) Blackwell Scientific Publications, Boston. Studies in Microbiology; V.2:409 pp. (ISBN 0-632-01318-4); Sambrook, J. et al. eds., Molecular Cloning: A Laboratory Manual (2d Ed. 1989) Cold Spring Harbor Laboratory Press, NY. Vols. 1-3 (ISBN 0-87969-309-6); Sustained and Controlled Release Drug Delivery Systems, J. R. Robinson, ed., Marcel Dekker, Inc., New York, 1978; Winnacker, E. L. From Genes To Clones: Introduction To Gene Technology (1987) VCH Publishers, N.Y. (translated by Horst Ibelgaufts). 634 pp. (ISBN 0-89573-6,4-4).

Further, the contents of all cited references (including literature references, patents, patent applications, and websites) that maybe cited throughout this application are hereby expressly incorporated by reference in their entirety for any purpose, as are the references cited therein.

Equivalents

That which is provided may be embodied in other specific forms without departing from the spirit or essential characteristics thereof. The foregoing embodiments described herein are therefore to be considered in all respects illustrative rather than limiting. Scope is thus indicated by the appended claims rather than by the foregoing description, and all changes that come within the meaning and range of equivalency of the claims are therefore intended to be embraced herein.

SEQUENCE LISTING (2093 sequences)

SEQ ID NO: 1 - protein, 121 aa, Artificial Sequence
  source: /note="Description of Artificial Sequence: Synthetic polypeptide"
  VARIANT (30)..(30): /replace="Ser"
  VARIANT (31)..(31): /replace="Gly"
  misc_feature (30)..(31): /note="Residues given in the sequence have no preference with respect to those in the annotations for said positions"
  VARIANT (34)..(34): /replace="Val" or "Leu"
  misc_feature (34)..(34): /note="Residue given in the sequence has no preference with respect to those in the annotations for said position"
  VARIANT (51)..(51): /replace="Ser"
  VARIANT (52)..(52): /replace="Asn"
  misc_feature (51)..(52): /note="Residues given in the sequence have no preference with respect to those in the annotations for said positions"
  VARIANT (55)..(55): /replace="Glu" or "Val" or "Tyr" or "Asn" or "Gly" or "Ala" or "Arg" or "Gln" or "His" or "Phe" or "Ile"
  misc_feature (55)..(55): /note="Residue given in the sequence has no preference with respect to those in the annotations for said position"
  VARIANT (58)..(58): /replace="Ile" or "Leu" or "Met" or "Asn"
  misc_feature (58)..(58): /note="Residue given in the sequence has no preference with respect to those in the annotations for said position"
  VARIANT (68)..(68): /replace="Phe"
  misc_feature (68)..(68): /note="Residue given in the sequence has no preference with respect the annotation for said position"
  VARIANT (81)..(81): /replace="Ile"
  misc_feature (81)..(81): /note="Residue given in the sequence has no preference with respect the annotation for said position"
  VARIANT (93)..(93): /replace="Met"
  misc_feature (93)..(93): /note="Residue given in the sequence has no preference with respect the annotation for said position"
  VARIANT (99)..(99): /replace="Glu"
  VARIANT (100)..(100): /replace="Thr" or "Ala"
  VARIANT (101)..(101): /replace="Asp" or "Val" or "Ala" or "Leu" or "Tyr" or "Trp" or "Gln" or "Asn" or "Met" or "Gly"
  VARIANT (102)..(102): /replace="Ser"
  VARIANT (103)..(103): /replace="Phe" or "Arg" or "Asn" or "Val" or "Ser" or "Pro" or "Ile"
  misc_feature (99)..(103): /note="Residues given in the sequence have no preference with respect to those in the annotations for said positions"
  VARIANT (105)..(105): /replace="Tyr" or "Phe" or "Val"
  VARIANT (106)..(106): /replace="Gln" or "Ile"
  VARIANT (107)..(107): /replace="Phe"
  misc_feature (105)..(107): /note="Residues given in the sequence have no preference with respect to those in the annotations for said positions"
  VARIANT (113)..(113): /replace="Gln"
  misc_feature (113)..(113): /note="Residue given in the sequence has no preference with respect the annotation for said position"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSEGYWEKYFQHWGPGTLVTVSS

SEQ ID NO: 2 - protein, 109 aa, Artificial Sequence
  source: /note="Description of Artificial Sequence: Synthetic polypeptide"
  VARIANT (28)..(28): /replace="Asp" or "Pro" or "Gly" or "Ser" or "Asn" or "Glu" or "Thr" or "His"
  misc_feature (28)..(28): /note="Residue given in the sequence has no preference with respect to those in the annotations for said position"
  VARIANT (31)..(31): /replace="Ile" or "Val" or "Thr" or "Gly" or "Met"
  VARIANT (32)..(32): /replace="Glu" or "Asp" or "Trp" or "Tyr" or "Asn"
  misc_feature (31)..(32): /note="Residues given in the sequence have no preference with respect to those in the annotations for said positions"
  VARIANT (35)..(35): /replace="Thr"
  misc_feature (35)..(35): /note="Residue given in the sequence has no preference with respect to the annotation for said position"
  VARIANT (49)..(49): /replace="Phe"
  VARIANT (50)..(50): /replace="Val"
  VARIANT (51)..(51): /replace="Tyr"
  misc_feature (49)..(51): /note="Residues given in the sequence have no preference with respect to those in the annotations for said positions"
  VARIANT (54)..(54): /replace="Asp" or "Ile" or "Arg" or "Val" or "Thr"
  VARIANT (55)..(55): /replace="Glu"
  misc_feature (54)..(55): /note="Residues given in the sequence have no preference with respect to those in the annotations for said positions"
  VARIANT (57)..(57): /replace="Gln" or "Asn" or "Asp"
  misc_feature (57)..(57): /note="Residue given in the sequence has no preference with respect to those in the annotations for said position"
  VARIANT (93)..(93): /replace="Asp"
  VARIANT (94)..(94): /replace="Asp" or "Phe" or "Asn"
  VARIANT (95)..(95): /replace="Arg"
  VARIANT (96)..(96): /replace="Ser"
  VARIANT (97)..(97): /replace="Ser" or "Asn" or "Arg"
  VARIANT (98)..(98): /replace="Leu" or "Met" or "Phe"
  misc_feature (93)..(98): /note="Residues given in the sequence have no preference with respect to those in the annotations for said positions"
  VARIANT (105)..(105): /replace="Asn"
  misc_feature (105)..(105): /note="Residue given in the sequence has no preference with respect to the annotation for said position"
QAVVTQEPSLTVSPGGTVTLTCGSSTGAVTSGHYPYWFQQKPGQAPRTLISDTNDKHSWTPARFSGSLLGGKAALTLSGAQPEDEAEYYCLLFYGGTVVFGGGTKLTVL

SEQ ID NO: 3 - protein, 119 aa, Homo sapiens
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 4 - protein, 112 aa, Homo sapiens
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 5 - protein, 126 aa, Homo sapiens
EVQLLESGGGLVKPGRSLRLSCVAYGFSLTGYSMNWVRQAPGKGLEWVSSISPNDTYRHYADSVKGRFTISRDNAKNSLYLQMNSLRAEDTAVYYCARDTNYRDSGGYFYDVFDIWGQGTMVTVSS

SEQ ID NO: 6 - protein, 107 aa, Homo sapiens
SYELTQPPSVSVAPGETARVTCEGNNIGNKGVHWYQQKPGQAPVLVVYDDSDRPSGIPERFSGSNSGNTATLTISRVEAGDDADYYCQVWDSSSDVFGSGTKVTVLG

SEQ ID NO: 7 - protein, 118 aa, Homo sapiens
EVQLVESGGGLVQPGGSLRLSCAASGFRFTDYWMTWVRQAPGKGPEWVANINEDGSKKHYADSVKDRFIISRDNAKKSLSLQMKRMRAEDTAVYYCAADLNPHWLVGWGQGTLVTVSS

SEQ ID NO: 8 - protein, 106 aa, Homo sapiens
QPVLTQPPSVSVAPGKTARITCGGNNIGSRRVHWYQQKPGQAPVLVVYDDNDRPSGIPERFSGSKSGNTATLTISRVEAGDEADYYCQVWHSGRVFGTGTKVTVLG

SEQ ID NO: 9 - protein, 118 aa, Homo sapiens
EVQLLESGGGLVQPGGSLRLSCAASGFTFRSYWMSWVRQAPGKGLEWVASIKQDGSKKHYADSVKDRFIISRDNAKKSLSLQMKRMRAEDTAVYYCAADLNPHWLVGWGQGTLVTVSS

SEQ ID NO: 10 - protein, 113 aa, Homo sapiens
DIVMTQTPLSLPVTPGEPASISCRSSQSLLHSNGYNYLDWYLQKPGQSPQLLIYLGSKRASGVPDRFSGSGSGTDFTLKISRVGAEDVGVYYCMQGLQTPKAFGPGTKVDIKR

SEQ ID NO: 11 - protein, 122 aa, Homo sapiens
EMQLVQSGAEVKKPGASVKVSCKASGYTFSGYYMNWVRQAPGQGLEWMGWINPYSGAATYAQDFQGRITVTRDTSISTGYMELTRLTSTDTAVYYCARGGTITGASWYFDVWGRGTLVTVSS

SEQ ID NO: 12 - protein, 114 aa, Homo sapiens
DIVMTQTPLSLPVTLGQPASISCRSSQSLVHSDGNTYLNWFQQRPGQSPRRLIYKVSNRDSGVPDRFSGSGSGTDFTLKISRVEAEDVGVYYCMQGTHWPQLTFGGGTKVEIKR

SEQ ID NO: 13 - protein, 133 aa, Homo sapiens
EVQLQQSGPGLVKPSQTLSLTCAISGDSVSSNIVAWNWIRQSPSRGLEWLGRTYYTSKWFNQYAMSVKSRITINPDTSKNQVSLKLSSVTAADTAAYYCARVGGTYDFWSGYYRPYYYGMDVWGQGTMVTVSS

SEQ ID NO: 14 - protein, 108 aa, Homo sapiens
DIRLTQSPSSLSASIGDTVTISCRSSQPINTHLNWFRQLPGRAPELLIYGSSSLHTGVPSRFSGSGSGTDFTLTITSLQRGDFLTYYCQQTHRLPITFGQGTRLDIKR

SEQ ID NO: 15 - protein, 7 aa, Artificial Sequence
  source: /note="Description of Artificial Sequence: Synthetic peptide"
  VARIANT (1)..(1): /replace="Gly" or "Ser"
  VARIANT (2)..(3): /replace=" "
  VARIANT (4)..(4): /replace="Val"
  VARIANT (5)..(5): /replace="Ser" or "Trp" or "Tyr"
  VARIANT (6)..(6): /replace="Met" or "Trp"
  VARIANT (7)..(7): /replace="Asn" or "Thr" or "Ser"
  misc_feature (1)..(7): /note="Residues given in the sequence have no preference with respect to those in the annotations for said positions"
DNIYALH

SEQ ID NO: 16 - protein, 18 aa, Artificial Sequence
  source: /note="Description of Artificial Sequence: Synthetic peptide"
  VARIANT (1)..(1): /replace="Ser" or "Asn" or "Trp" or "Arg"
  VARIANT (2)..(2): /replace="Thr"
  VARIANT (3)..(3): /replace="Asn" or "Lys" or "Tyr"
  VARIANT (4)..(4): /replace="Pro" or "Glu" or "Gln" or "Tyr"
  VARIANT (5)..(5): /replace="Asn" or "Asp" or "Tyr" or "Thr"
  VARIANT (6)..(6): /replace="Asp" or "Ser"
  VARIANT (7)..(7): /replace="Thr" or "Ser" or "Gly" or "Lys"
  VARIANT (8)..(8): /replace="Tyr" or "Lys" or "Ala" or "Trp"
  VARIANT (9)..(9): /replace="Arg" or "Lys" or "Ala" or "Phe"
  VARIANT (10)..(10): /replace=" "
  VARIANT (11)..(11): /replace="His" or "Thr" or "Gln"
  misc_feature (1)..(11): /note="Residues given in the sequence have no preference with respect to those in the annotations for said positions"
  VARIANT (14)..(14): /replace="Gln" or "Met"
  VARIANT (15)..(15): /replace="Ser" or "Asp"
  VARIANT (16)..(16): /replace="Phe"
  VARIANT (17)..(17): /replace="Gln"
  VARIANT (18)..(18): /replace="Asp"" or "Ser"
  misc_feature (14)..(18): /note="Residues given in the sequence have no preference with respect to those in the annotations for said positions"
GISWHGDFINDYADSVKG

SEQ ID NO: 17 - protein, 21 aa, Artificial Sequence
  source: /note="Description of Artificial Sequence: Synthetic peptide"
  VARIANT (1)..(1): /replace="Gly" or "Val"
  VARIANT (2)..(2): /replace="Leu" or "Gly"
  VARIANT (3)..(3): /replace="Thr" or "Gly"
  VARIANT (4)..(4): /replace="Tyr" or "Pro" or "Ile" or "Thr"
  VARIANT (5)..(5): /replace="His" or "Thr" or "Tyr"
  VARIANT (6)..(6): /replace="Asp" or "Trp"
  VARIANT (7)..(7): /replace="Ser" or "Leu" or "Ala" or "Phe"
  VARIANT (8)..(8): /replace="Val" or "Ser" or "Trp"
  VARIANT (9)..(9): /replace="Trp" or "Ser"
  VARIANT (10)..(10): /replace="Gly" or " "
  VARIANT (11)..(11): /replace="Tyr" or " "
  VARIANT (12)..(16): /replace=" "
  VARIANT (17)..(17): /replace="Tyr" or " "
  VARIANT (18)..(18): /replace="Gly" or " "
  VARIANT (19)..(19): /replace="Phe" or "Met" or " "
  VARIANT (20)..(20): /replace=" "
  VARIANT (21)..(21): /replace="Ile" or " "
  misc_feature (1)..(21): /note="Residues given in the sequence have no preference with respect to those in the annotations for said positions"
DTNNRGYGGYFYRPYYDVLDV

SEQ ID NO: 18 - protein, 16 aa, Artificial Sequence
  source: /note="Description of Artificial Sequence: Synthetic peptide"
  VARIANT (1)..(1): /replace="Glu" or "Gly" or "Arg"
  VARIANT (2)..(2): /replace="Ser"
  VARIANT (3)..(3): /replace="Asn"
  VARIANT (4)..(4): /replace="Gln"
  VARIANT (5)..(6): /replace=" "
  VARIANT (7)..(7): /replace="Val"
  VARIANT (8)..(8): /replace="His"
  VARIANT (9)..(9): /replace="Ser"
  VARIANT (10)..(10): /replace="Asn" or "Asp" or "Pro"
  VARIANT (11)..(11): /replace="Ile"
  VARIANT (12)..(12): /replace="Asn" or "Tyr"
  VARIANT (13)..(13): /replace="Lys" or "Arg" or "Thr"
  VARIANT (14)..(14): /replace="Gly" or "Arg" or "Tyr" or "His"
  VARIANT (15)..(15): /replace="Leu"
  VARIANT (16)..(16): /replace="His" or "Asp"
  misc_feature (1)..(16): /note="Residues given in the sequence have no preference with respect to those in the annotations for said positions"
SGSSSLLSNIGSNTVN

SEQ ID NO: 19 - protein, 7 aa, Artificial Sequence
  source: /note="Description of Artificial Sequence: Synthetic peptide"
  VARIANT (1)..(1): /replace="Asp" or "Leu" or "Lys" or "Gly"
  VARIANT (2)..(2): /replace="Asp" or "Gly" or "Val" or "Ser"
  VARIANT (3)..(3): /replace="Ser"
  VARIANT (4)..(4): /replace="Asp" or "Lys" or "Asn" or "Ser"
  VARIANT (5)..(5): /replace="Leu"
  VARIANT (6)..(6): /replace="Ala" or "Asp" or "His"
  VARIANT (7)..(7): /replace="Thr"
  misc_feature (1)..(7): /note="Residues given in the sequence have no preference with respect to those in the annotations for said positions"
SNNQRPS

SEQ ID NO: 20 - protein, 12 aa, Artificial Sequence
  source: /note="Description of Artificial Sequence: Synthetic peptide"
  VARIANT (1)..(1): /replace="Gln" or "Met"
  VARIANT (2)..(2): /replace="Val" or "Gln"
  VARIANT (3)..(3): /replace="Gly"
  VARIANT (4)..(4): /replace="His" or "Leu" or "Thr"
  VARIANT (5)..(5): /replace="Ser" or "Gln" or "His"
  VARIANT (6)..(6): /replace="Gly" or "Thr" or "Trp" or "Arg"
  VARIANT (7)..(8): /replace="Pro" or " "
  VARIANT (9)..(9): /replace="Ile" or " "
  VARIANT (10)..(10): /replace="Gln" or "Thr" or " "
  VARIANT (11)..(11): /replace="Asp" or "Arg" or "Lys" or "Leu" or " "
  VARIANT (12)..(12): /replace="Ala" or "Thr" or " "
  misc_feature (1)..(12): /note="Residues given in the sequence have no preference with respect to those in the annotations for said positions"
AAWDDSLNGSYV

SEQ ID NO: 21 - protein, 253 aa, Artificial Sequence
  source: /note="Description of Artificial Sequence: Synthetic polypeptide"
EIQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSSGGGGSGGGGSEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 22 - protein, 124 aa, Artificial Sequence
  source: /note="Description of Artificial Sequence: Synthetic polypeptide"
EIQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS

SEQ ID NO: 23 - protein, 10 aa, Artificial Sequence
  source: /note="Description of Artificial Sequence: Synthetic peptide"
GGGGSGGGGS

SEQ ID NO: 24 - protein, 119 aa, Artificial Sequence; identical to SEQ ID NO: 3
  source: /note="Description of Artificial Sequence: Synthetic polypeptide"

SEQ ID NO: 25 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 229 aa, Artificial Sequence
  source: /note="Description of Artificial Sequence: Synthetic polypeptide"
DIQMTQSPSSLSASVGDRVTITCRASQDISNYLNWYQQKPGKTVKLLIYYTSRLQSGVPSRFSGSGSGTDYTLTISSLQPEDFATYFCQQGNTLPPTFGQGTKLEIKRGGSGGGGSGQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 27 - protein, 108 aa, Artificial Sequence
  source: /note="Description of Artificial Sequence: Synthetic polypeptide"
DIQMTQSPSSLSASVGDRVTITCRASQDISNYLNWYQQKPGKTVKLLIYYTSRLQSGVPSRFSGSGSGTDYTLTISSLQPEDFATYFCQQGNTLPPTFGQGTKLEIKR

SEQ ID NO: 28 - protein, 9 aa, Artificial Sequence
  source: /note="Description of Artificial Sequence: Synthetic peptide"
GGSGGGGSG

SEQ ID NO: 29 - protein, 112 aa, Artificial Sequence; identical to SEQ ID NO: 4
  source: /note="Description of Artificial Sequence: Synthetic polypeptide"

SEQ ID NO: 30 - protein, 105 aa, Artificial Sequence
  source: /note="Description of Artificial Sequence: Synthetic polypeptide"
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 31 - protein, 253 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSGGGGSGGGGSEIQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS

SEQ ID NO: 32 - protein, 119 aa, Artificial Sequence; identical to SEQ ID NO: 3
  source: /note="Description of Artificial Sequence: Synthetic polypeptide"

SEQ ID NO: 33 - protein, 10 aa, Artificial Sequence
  source: /note="Description of Artificial Sequence: Synthetic peptide"
GGGGSGGGGS

SEQ ID NO: 34 - protein, 124 aa, Artificial Sequence; identical to SEQ ID NO: 22
  source: /note="Description of Artificial Sequence: Synthetic polypeptide"

SEQ ID NO: 35 - protein, 330 aa, Artificial Sequence; identical to SEQ ID NO: 25
  source: /note="Description of Artificial Sequence: Synthetic polypeptide"

SEQ ID NO: 36 - protein, 229 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGGGSGGGGSGDIQMTQSPSSLSASVGDRVTITCRASQDISNYLNWYQQKPGKTVKLLIYYTSRLQSGVPSRFSGSGSGTDYTLTISSLQPEDFATYFCQQGNTLPPTFGQGTKLEIKR

SEQ ID NO: 37 - protein, 112 aa, Artificial Sequence; identical to SEQ ID NO: 4
  source: /note="Description of Artificial Sequence: Synthetic polypeptide"

SEQ ID NO: 38 - protein, 9 aa, Artificial Sequence
  source: /note="Description of Artificial Sequence: Synthetic peptide"
GGSGGGGSG

SEQ ID NO: 39 - protein, 108 aa, Artificial Sequence; identical to SEQ ID NO: 27
  source: /note="Description of Artificial Sequence: Synthetic polypeptide"

SEQ ID NO: 40 - protein, 106 aa, Artificial Sequence
  source: /note="Description of Artificial Sequence: Synthetic polypeptide"
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 249 aa, Artificial Sequence
  source: /note="Description of Artificial Sequence: Synthetic polypeptide"
EIQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSSASTKGPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 42 - protein, 124 aa, Artificial Sequence; identical to SEQ ID NO: 22
  source: /note="Description of Artificial Sequence: Synthetic polypeptide"

SEQ ID NO: 43 - protein, 6 aa, Artificial Sequence
  source: /note="Description of Artificial Sequence: Synthetic peptide"
ASTKGP

SEQ ID NO: 44 - protein, 119 aa, Artificial Sequence; identical to SEQ ID NO: 3
  source: /note="Description of Artificial Sequence: Synthetic polypeptide"

SEQ ID NO: 45 - protein, 330 aa, Artificial Sequence; identical to SEQ ID NO: 25
  source: /note="Description of Artificial Sequence: Synthetic polypeptide"

SEQ ID NO: 46 - protein, 225 aa, Artificial Sequence
  source: /note="Description of Artificial Sequence: Synthetic polypeptide"
DIQMTQSPSSLSASVGDRVTITCRASQDISNYLNWYQQKPGKTVKLLIYYTSRLQSGVPSRFSGSGSGTDYTLTISSLQPEDFATYFCQQGNTLPPTFGQGTKLEIKRTVAAPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 47 - protein, 108 aa, Artificial Sequence; identical to SEQ ID NO: 27
  source: /note="Description of Artificial Sequence: Synthetic polypeptide"

SEQ ID NO: 48 - protein, 5 aa, Artificial Sequence
  source: /note="Description of Artificial Sequence: Synthetic peptide"
TVAAP

SEQ ID NO: 49 - protein, 112 aa, Artificial Sequence; identical to SEQ ID NO: 4
  source: /note="Description of Artificial Sequence: Synthetic polypeptide"

SEQ ID NO: 50 - protein, 105 aa, Artificial Sequence; identical to SEQ ID NO: 30
  source: /note="Description of Artificial Sequence: Synthetic polypeptide"

SEQ ID NO: 51 - protein, 249 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPEIQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS

SEQ ID NO: 52 - protein, 119 aa, Artificial Sequence; identical to SEQ ID NO: 3
  source: /note="Description of Artificial Sequence: Synthetic polypeptide"

SEQ ID NO: 53 - protein, 6 aa, Artificial Sequence
  source: /note="Description of Artificial Sequence: Synthetic peptide"
ASTKGP

SEQ ID NO: 54 - protein, 124 aa, Artificial Sequence; identical to SEQ ID NO: 22
  source: /note="Description of Artificial Sequence: Synthetic polypeptide"

SEQ ID NO: 55 - protein, 330 aa, Artificial Sequence; identical to SEQ ID NO: 25
  source: /note="Description of Artificial Sequence: Synthetic polypeptide"

SEQ ID NO: 56 - protein, 226 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPDIQMTQSPSSLSASVGDRVTITCRASQDISNYLNWYQQKPGKTVKLLIYYTSRLQSGVPSRFSGSGSGTDYTLTISSLQPEDFATYFCQQGNTLPPTFGQGTKLEIKR

SEQ ID NO: 57 - protein, 112 aa, Artificial Sequence; identical to SEQ ID NO: 4
  source: /note="Description of Artificial Sequence: Synthetic polypeptide"

SEQ ID NO: 58 - protein, 6 aa, Artificial Sequence
  source: /note="Description of Artificial Sequence: Synthetic peptide"
QPKAAP

SEQ ID NO: 59 - protein, 108 aa, Artificial Sequence; identical to SEQ ID NO: 27
  source: /note="Description of Artificial Sequence: Synthetic polypeptide"

SEQ ID NO: 60 - protein, 106 aa, Artificial Sequence; identical to SEQ ID NO: 40
  source: /note="Description of Artificial Sequence: Synthetic polypeptide"

SEQ ID NO: 61 - protein, 249 aa, Artificial Sequence; identical to SEQ ID NO: 41
  source: /note="Description of Artificial Sequence: Synthetic polypeptide"

SEQ ID NO: 62 - protein, 124 aa, Artificial Sequence; identical to SEQ ID NO: 22
  source: /note="Description of Artificial Sequence: Synthetic polypeptide"

SEQ ID NO: 63 - protein, 6 aa, Artificial Sequence
  source: /note="Description of Artificial Sequence: Synthetic peptide"
ASTKGP

SEQ ID NO: 64 - protein, 119 aa, Artificial Sequence; identical to SEQ ID NO: 3
  source: /note="Description of Artificial Sequence: Synthetic polypeptide"

SEQ ID NO: 65 - protein, 330 aa, Artificial Sequence; identical to SEQ ID NO: 25
  source: /note="Description of Artificial Sequence: Synthetic polypeptide"

SEQ ID NO: 66 - protein, 232 aa, Artificial Sequence
  source: /note="Description of Artificial Sequence: Synthetic polypeptide"
DIQMTQSPSSLSASVGDRVTITCRASQDISNYLNWYQQKPGKTVKLLIYYTSRLQSGVPSRFSGSGSGTDYTLTISSLQPEDFATYFCQQGNTLPPTFGQGTKLEIKRTVAAPSVFIFPPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 67 - protein, 108 aa, Artificial Sequence; identical to SEQ ID NO: 27
  source: /note="Description of Artificial Sequence: Synthetic polypeptide"

SEQ ID NO: 68 - protein, 12 aa, Artificial Sequence
  source: /note="Description of Artificial Sequence: Synthetic peptide"
TVAAPSVFIFPP

SEQ ID NO: 69 - protein, 112 aa, Artificial Sequence; identical to SEQ ID NO: 4
  source: /note="Description of Artificial Sequence: Synthetic polypeptide"

SEQ ID NO: 70 - protein, 105 aa, Artificial Sequence; identical to SEQ ID NO: 30
  source: /note="Description of Artificial Sequence: Synthetic polypeptide"

SEQ ID NO: 71 - protein, 249 aa, Artificial Sequence; identical to SEQ ID NO: 51
  source: /note="Description of Artificial Sequence: Synthetic polypeptide"

SEQ ID NO: 72 - protein, 119 aa, Artificial Sequence; identical to SEQ ID NO: 3
  source: /note="Description of Artificial Sequence: Synthetic polypeptide"

SEQ ID NO: 73 - protein, 6 aa, Artificial Sequence
  source: /note="Description of Artificial Sequence: Synthetic peptide"
ASTKGP

SEQ ID NO: 74 - protein, 124 aa, Artificial Sequence; identical to SEQ ID NO: 22
  source: /note="Description of Artificial Sequence: Synthetic polypeptide"

SEQ ID NO: 75 - protein, 330 aa, Artificial Sequence; identical to SEQ ID NO: 25
  source: /note="Description of Artificial Sequence: Synthetic polypeptide"

SEQ ID NO: 76 - protein, 233 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPSVTLFPPDIQMTQSPSSLSASVGDRVTITCRASQDISNYLNWYQQKPGKTVKLLIYYTSRLQSGVPSRFSGSGSGTDYTLTISSLQPEDFATYFCQQGNTLPPTFGQGTKLEIKR

SEQ ID NO: 77 - protein, 112 aa, Artificial Sequence; identical to SEQ ID NO: 4
  source: /note="Description of Artificial Sequence: Synthetic polypeptide"

SEQ ID NO: 78 - protein, 13 aa, Artificial Sequence
  source: /note="Description of Artificial Sequence: Synthetic peptide"
QPKAAPSVTLFPP

SEQ ID NO: 79 - protein, 108 aa, Artificial Sequence; identical to SEQ ID NO: 27
  source: /note="Description of Artificial Sequence: Synthetic polypeptide"

SEQ ID NO: 80 - protein, 106 aa, Artificial Sequence; identical to SEQ ID NO: 40
  source: /note="Description of Artificial Sequence: Synthetic polypeptide"

SEQ ID NO: 81 - protein, 256 aa, Artificial Sequence
  source: /note="Description of Artificial Sequence: Synthetic polypeptide"
EIQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSSASTKGPSVFPLAPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 82 - protein, 124 aa, Artificial Sequence; identical to SEQ ID NO: 22
  source: /note="Description of Artificial Sequence: Synthetic polypeptide"

SEQ ID NO: 83 - protein, 13 aa, Artificial Sequence
  source: /note="Description of Artificial Sequence: Synthetic peptide"
ASTKGPSVFPLAP

SEQ ID NO: 84 - protein, 119 aa, Artificial Sequence; identical to SEQ ID NO: 3
  source: /note="Description of Artificial Sequence: Synthetic polypeptide"

SEQ ID NO: 85 - protein, 330 aa, Artificial Sequence; identical to SEQ ID NO: 25
  source: /note="Description of Artificial Sequence: Synthetic polypeptide"

SEQ ID NO: 86 - protein, 225 aa, Artificial Sequence; identical to SEQ ID NO: 46
  source: /note="Description of Artificial Sequence: Synthetic polypeptide"

SEQ ID NO: 87 - protein, 108 aa, Artificial Sequence; identical to SEQ ID NO: 27
  source: /note="Description of Artificial Sequence: Synthetic polypeptide"

SEQ ID NO: 88 - protein, 5 aa, Artificial Sequence
  source: /note="Description of Artificial Sequence: Synthetic peptide"
TVAAP

SEQ ID NO: 89 - protein, 112 aa, Artificial Sequence; identical to SEQ ID NO: 4
  source: /note="Description of Artificial Sequence: Synthetic polypeptide"

SEQ ID NO: 90 - protein, 105 aa, Artificial Sequence; identical to SEQ ID NO: 30
  source: /note="Description of Artificial Sequence: Synthetic polypeptide"

SEQ ID NO: 91 - protein, 256 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPSVFPLAPEIQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS

SEQ ID NO: 92 - protein, 119 aa, Artificial Sequence; identical to SEQ ID NO: 3
  source: /note="Description of Artificial Sequence: Synthetic polypeptide"

SEQ ID NO: 93 - protein, 13 aa, Artificial Sequence
  source: /note="Description of Artificial Sequence: Synthetic peptide"
ASTKGPSVFPLAP

SEQ ID NO: 94 - protein, 124 aa, Artificial Sequence; identical to SEQ ID NO: 22
  source: /note="Description of Artificial Sequence: Synthetic polypeptide"

SEQ ID NO: 95 - protein, 330 aa, Artificial Sequence; identical to SEQ ID NO: 25
  source: /note="Description of Artificial Sequence: Synthetic polypeptide"

SEQ ID NO: 96 - protein, 226 aa, Artificial Sequence; identical to SEQ ID NO: 56
  source: /note="Description of Artificial Sequence: Synthetic polypeptide"

SEQ ID NO: 97 - protein, 112 aa, Artificial Sequence; identical to SEQ ID NO: 4
  source: /note="Description of Artificial Sequence: Synthetic polypeptide"

SEQ ID NO: 98 - protein, 6 aa, Artificial Sequence
  source: /note="Description of Artificial Sequence: Synthetic peptide"
QPKAAP

SEQ ID NO: 99 - protein, 108 aa, Artificial Sequence; identical to SEQ ID NO: 27
  source: /note="Description of Artificial Sequence: Synthetic polypeptide"

SEQ ID NO: 100 - protein, 106 aa, Artificial Sequence; identical to SEQ ID NO: 40
  source: /note="Description of Artificial Sequence: Synthetic polypeptide"

SEQ ID NO: 101 - protein, 253 aa, Artificial Sequence
  source: /note="Description of Artificial Sequence: Synthetic polypeptide"
EVQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSSGGGGSGGGGSEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 102 - protein, 124 aa, Artificial Sequence
  source: /note="Description of Artificial Sequence: Synthetic polypeptide"
EVQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS

SEQ ID NO: 103 - protein, 10 aa, Artificial Sequence
  source: /note="Description of Artificial Sequence: Synthetic peptide"
GGGGSGGGGS

SEQ ID NO: 104 - protein, 119 aa, Artificial Sequence; identical to SEQ ID NO: 3
  source: /note="Description of Artificial Sequence: Synthetic polypeptide"

SEQ ID NO: 105 - protein, 330 aa, Artificial Sequence; identical to SEQ ID NO: 25
  source: /note="Description of Artificial Sequence: Synthetic polypeptide"

SEQ ID NO: 106 - protein, 229 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIKRGGSGGGGSGQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 107 - protein, 108 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIKR

SEQ ID NO: 108 - protein, 9 aa, Artificial Sequence
  source: /note="Description of Artificial Sequence: Synthetic peptide"
GGSGGGGSG

SEQ ID NO: 109 - protein, 112 aa, Artificial Sequence; identical to SEQ ID NO: 4
  source: /note="Description of Artificial Sequence: Synthetic polypeptide"

SEQ ID NO: 110 - protein, 105 aa, Artificial Sequence; identical to SEQ ID NO: 30
  source: /note="Description of Artificial Sequence: Synthetic polypeptide"

SEQ ID NO: 111 - protein, 253 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSGGGGSGGGGSEVQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS

SEQ ID NO: 112 - protein, 119 aa, Artificial Sequence; identical to SEQ ID NO: 3
  source: /note="Description of Artificial Sequence: Synthetic polypeptide"

SEQ ID NO: 113 - protein, 10 aa, Artificial Sequence
  source: /note="Description of Artificial Sequence: Synthetic peptide"
GGGGSGGGGS

SEQ ID NO: 114 - protein, 124 aa, Artificial Sequence; identical to SEQ ID NO: 102
  source: /note="Description of Artificial Sequence: Synthetic polypeptide"

SEQ ID NO: 115 - protein, 330 aa, Artificial Sequence; identical to SEQ ID NO: 25
  source: /note="Description of Artificial Sequence: Synthetic polypeptide"

SEQ ID NO: 116 - protein, 229 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGGGSGGGGSGDIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIKR

SEQ ID NO: 117 - protein, 112 aa, Artificial Sequence; identical to SEQ ID NO: 4
  source: /note="Description of Artificial Sequence: Synthetic polypeptide"

SEQ ID NO: 118 - protein, 9 aa, Artificial Sequence
  source: /note="Description of Artificial Sequence: Synthetic peptide"
GGSGGGGSG

SEQ ID NO: 119 - protein, 108 aa, Artificial Sequence; identical to SEQ ID NO: 107
  source: /note="Description of Artificial Sequence: Synthetic polypeptide"

SEQ ID NO: 120 - protein, 106 aa, Artificial Sequence; identical to SEQ ID NO: 40
  source: /note="Description of Artificial Sequence: Synthetic polypeptide"

SEQ ID NO: 121 - protein, 249 aa, Artificial Sequence
  source: /note="Description of Artificial Sequence: Synthetic polypeptide"
EVQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSSASTKGPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 122 - protein, 124 aa, Artificial Sequence; identical to SEQ ID NO: 102
  source: /note="Description of Artificial Sequence: Synthetic polypeptide"

SEQ ID NO: 123 - protein, 6 aa, Artificial Sequence
  source: /note="Description of Artificial Sequence: Synthetic peptide"
ASTKGP

SEQ ID NO: 124 - protein, 119 aa, Artificial Sequence; identical to SEQ ID NO: 3
  source: /note="Description of Artificial Sequence: Synthetic polypeptide"

SEQ ID NO: 125 - protein, 330 aa, Artificial Sequence; identical to SEQ ID NO: 25
  source: /note="Description of Artificial Sequence: Synthetic polypeptide"

SEQ ID NO: 126 - protein, 225 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIKRTVAAPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 127 - protein, 108 aa, Artificial Sequence; identical to SEQ ID NO: 107
  source: /note="Description of Artificial Sequence: Synthetic polypeptide"

SEQ ID NO: 128 - protein, 5 aa, Artificial Sequence
  source: /note="Description of Artificial Sequence: Synthetic peptide"
TVAAP

SEQ ID NO: 129 - protein, 112 aa, Artificial Sequence; identical to SEQ ID NO: 4
  source: /note="Description of Artificial Sequence: Synthetic polypeptide"

SEQ ID NO: 130 - protein, 105 aa, Artificial Sequence; identical to SEQ ID NO: 30
  source: /note="Description of Artificial Sequence: Synthetic polypeptide"

SEQ ID NO: 131 - protein, 249 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPEVQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS

SEQ ID NO: 132 - protein, 119 aa, Artificial Sequence; identical to SEQ ID NO: 3
  source: /note="Description of Artificial Sequence: Synthetic polypeptide"

SEQ ID NO: 133 - protein, 6 aa, Artificial Sequence
  source: /note="Description of Artificial Sequence: Synthetic peptide"
ASTKGP

SEQ ID NO: 134 - protein, 124 aa, Artificial Sequence; identical to SEQ ID NO: 102
  source: /note="Description of Artificial Sequence: Synthetic polypeptide"

SEQ ID NO: 135 - protein, 330 aa, Artificial Sequence; identical to SEQ ID NO: 25
  source: /note="Description of Artificial Sequence: Synthetic polypeptide"

SEQ ID NO: 136 - protein, 226 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPDIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIKR

SEQ ID NO: 137 - protein, 112 aa, Artificial Sequence; identical to SEQ ID NO: 4
  source: /note="Description of Artificial Sequence: Synthetic polypeptide"

SEQ ID NO: 138 - protein, 6 aa, Artificial Sequence
  source: /note="Description of Artificial Sequence: Synthetic peptide"
QPKAAP

SEQ ID NO: 139 - protein, 108 aa, Artificial Sequence; identical to SEQ ID NO: 107
  source: /note="Description of Artificial Sequence: Synthetic polypeptide"

SEQ ID NO: 140 - protein, 106 aa, Artificial Sequence; identical to SEQ ID NO: 40
  source: /note="Description of Artificial Sequence: Synthetic polypeptide"

SEQ ID NO: 141 - protein, 249 aa, Artificial Sequence; identical to SEQ ID NO: 121
  source: /note="Description of Artificial Sequence: Synthetic polypeptide"

SEQ ID NO: 142 - protein, 124 aa, Artificial Sequence; identical to SEQ ID NO: 102
  source: /note="Description of Artificial Sequence: Synthetic polypeptide"

SEQ ID NO: 143 - protein, 6 aa, Artificial Sequence
  source: /note="Description of Artificial Sequence: Synthetic peptide"
ASTKGP

SEQ ID NO: 144 - protein, 119 aa, Artificial Sequence; identical to SEQ ID NO: 3
  source: /note="Description of Artificial Sequence: Synthetic polypeptide"

SEQ ID NO: 145 - protein, 330 aa, Artificial Sequence; identical to SEQ ID NO: 25
  source: /note="Description of Artificial Sequence: Synthetic polypeptide"

SEQ ID NO: 146 - protein, 232 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIKRTVAAPSVFIFPPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 147 - protein, 108 aa, Artificial Sequence; identical to SEQ ID NO: 107
  source: /note="Description of Artificial Sequence: Synthetic polypeptide"

SEQ ID NO: 148 - protein, 12 aa, Artificial Sequence
  source: /note="Description of Artificial Sequence: Synthetic peptide"
TVAAPSVFIFPP

SEQ ID NO: 149 - protein, 112 aa, Artificial Sequence; identical to SEQ ID NO: 4
  source: /note="Description of Artificial Sequence: Synthetic polypeptide"

SEQ ID NO: 150 - protein, 105 aa, Artificial Sequence; identical to SEQ ID NO: 30
  source: /note="Description of Artificial Sequence: Synthetic polypeptide"

SEQ ID NO: 151 - protein, 249 aa, Artificial Sequence; identical to SEQ ID NO: 131
  source: /note="Description of Artificial Sequence: Synthetic polypeptide"

SEQ ID NO: 152 - protein, 119 aa, Artificial Sequence; identical to SEQ ID NO: 3
  source: /note="Description of Artificial Sequence: Synthetic polypeptide"

SEQ ID NO: 153 - protein, 6 aa, Artificial Sequence
  source: /note="Description of Artificial Sequence: Synthetic peptide"
ASTKGP

SEQ ID NO: 154 - protein, 124 aa, Artificial Sequence; identical to SEQ ID NO: 102
  source: /note="Description of Artificial Sequence: Synthetic polypeptide"

SEQ ID NO: 155 - protein, 330 aa, Artificial Sequence; identical to SEQ ID NO: 25
  source: /note="Description of Artificial Sequence: Synthetic polypeptide"

SEQ ID NO: 156 - protein, 233 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPSVTLFPPDIQMTQSPSSLSASVGDRVTITCRASQDISNYLNWYQQKPGKAPKLLIYYTSRLQSGVPSRFSGSGSGTDYTLTISSLQPEDFATYYCQQGNTLPPTFGQGTKLEIKR

SEQ ID NO: 157 - protein, 112 aa, Artificial Sequence; identical to SEQ ID NO: 4
  source: /note="Description of Artificial Sequence: Synthetic polypeptide"

SEQ ID NO: 158 - protein, 13 aa, Artificial Sequence
  source: /note="Description of Artificial Sequence: Synthetic peptide"
QPKAAPSVTLFPP

SEQ ID NO: 159 - protein, 108 aa, Artificial Sequence; identical to SEQ ID NO: 107
  source: /note="Description of Artificial Sequence: Synthetic polypeptide"

SEQ ID NO: 160 - protein, 106 aa, Artificial Sequence; identical to SEQ ID NO: 40
  source: /note="Description of Artificial Sequence: Synthetic polypeptide"

SEQ ID NO: 161 - protein, 256 aa, Artificial Sequence
  source: /note="Description of Artificial Sequence: Synthetic polypeptide"
EVQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSSASTKGPSVFPLAPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 162 - protein, 124 aa, Artificial Sequence; identical to SEQ ID NO: 102
  source: /note="Description of Artificial Sequence: Synthetic polypeptide"

SEQ ID NO: 163 - protein, 13 aa, Artificial Sequence
  source: /note="Description of Artificial Sequence: Synthetic peptide"
ASTKGPSVFPLAP

SEQ ID NO: 164 - protein, 119 aa, Artificial Sequence; identical to SEQ ID NO: 3
  source: /note="Description of Artificial Sequence: Synthetic polypeptide"

SEQ ID NO: 165 - protein, 330 aa, Artificial Sequence; identical to SEQ ID NO: 25
  source: /note="Description of Artificial Sequence: Synthetic polypeptide"

SEQ ID NO: 166 - protein, 225 aa, Artificial Sequence; identical to SEQ ID NO: 126
  source: /note="Description of Artificial Sequence: Synthetic polypeptide"

SEQ ID NO: 167 - protein, 108 aa, Artificial Sequence; identical to SEQ ID NO: 107
  source: /note="Description of Artificial Sequence: Synthetic polypeptide"

SEQ ID NO: 168 - protein, 5 aa, Artificial Sequence
  source: /note="Description of Artificial Sequence: Synthetic peptide"
TVAAP

SEQ ID NO: 169 - protein, 112 aa, Artificial Sequence; identical to SEQ ID NO: 4
  source: /note="Description of Artificial Sequence: Synthetic polypeptide"

SEQ ID NO: 170 - protein, 105 aa, Artificial Sequence; identical to SEQ ID NO: 30
  source: /note="Description of Artificial Sequence: Synthetic polypeptide"

SEQ ID NO: 171 - protein, 256 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPSVFPLAPEVQLVQSGSELKKPGASVKVSCKASGYTFTNYGMNWVRQAPGQGLEWMGWINTYTGEPTYADDFKGRFVFSLDTSVSTAYLQISSLKAEDTAVYFCARKFLTTVVVTDYAMDYWGQGTTVTVSS

SEQ ID NO: 172 - protein, 119 aa, Artificial Sequence; identical to SEQ ID NO: 3
  source: /note="Description of Artificial Sequence: Synthetic polypeptide"

SEQ ID NO: 173 - protein, 13 aa, Artificial Sequence
  source: /note="Description of Artificial Sequence: Synthetic peptide"
ASTKGPSVFPLAP

SEQ ID NO: 174 - protein, 124 aa, Artificial Sequence; identical to SEQ ID NO: 102
  source: /note="Description of Artificial Sequence: Synthetic polypeptide"

SEQ ID NO: 175 - protein, 330 aa, Artificial Sequence; identical to SEQ ID NO: 25
  source: /note="Description of Artificial Sequence: Synthetic polypeptide"

SEQ ID NO: 176 - protein, 226 aa, Artificial Sequence; identical to SEQ ID NO: 136
  source: /note="Description of Artificial Sequence: Synthetic polypeptide"

SEQ ID NO: 177 - protein, 112 aa, Artificial Sequence; identical to SEQ ID NO: 4
  source: /note="Description of Artificial Sequence: Synthetic polypeptide"

SEQ ID NO: 178 - protein, 6 aa, Artificial Sequence
  source: /note="Description of Artificial Sequence: Synthetic peptide"
QPKAAP

SEQ ID NO: 179 - protein, 108 aa, Artificial Sequence; identical to SEQ ID NO: 107
  source: /note="Description of Artificial Sequence: Synthetic polypeptide"

SEQ ID NO: 180 - protein, 106 aa, Artificial Sequence; identical to SEQ ID NO: 40
  source: /note="Description of Artificial Sequence: Synthetic polypeptide"

SEQ ID NO: 181 - protein, 253 aa, Artificial Sequence
  source: /note="Description of Artificial Sequence: Synthetic polypeptide"
QIQLVQSGPELKKPGETVMISCKASGYTFTNYGMNWVKQAPGKGLKWMGWINTYTGEPTYADDFKGRFAFSLETSASTAYLQINNLKNEDTATYFCARKFLTTVVVTDYAMDYWGQGTSVTVSSGGGGSGGGGSEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 182 - protein, 124 aa, Artificial Sequence
  source: /note="Description of Artificial Sequence: Synthetic polypeptide"
QIQLVQSGPELKKPGETVMISCKASGYTFTNYGMNWVKQAPGKGLKWMGWINTYTGEPTYADDFKGRFAFSLETSASTAYLQINNLKNEDTATYFCARKFLTTVVVTDYAMDYWGQGTSVTVSS

SEQ ID NO: 183 - protein, 10 aa, Artificial Sequence
  source: /note="Description of Artificial Sequence: Synthetic peptide"
GGGGSGGGGS

SEQ ID NO: 184 - protein, 119 aa, Artificial Sequence; identical to SEQ ID NO: 3
  source: /note="Description of Artificial Sequence: Synthetic polypeptide"

SEQ ID NO: 185 - protein, 330 aa, Artificial Sequence; identical to SEQ ID NO: 25
  source: /note="Description of Artificial Sequence: Synthetic polypeptide"

SEQ ID NO: 186 - protein, 229 aa, Artificial Sequence
  source: /note="Description of Artificial Sequence: Synthetic polypeptide"
DIQMTQTTSSLSASLGDRVTISCRASQDISNYLNWYQQKPDGTVKLLIYYTSRLQSGVPSRFSGSGSGTDYSLTISNLEQEDIATYFCQQGNTLPPTFGVGTKLELKRGGSGGGGSGQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 187 - protein, 108 aa, Artificial Sequence
  source: /note="Description of Artificial Sequence: Synthetic polypeptide"
DIQMTQTTSSLSASLGDRVTISCRASQDISNYLNWYQQKPDGTVKLLIYYTSRLQSGVPSRFSGSGSGTDYSLTISNLEQEDIATYFCQQGNTLPPTFGVGTKLELKR

SEQ ID NO: 188 - protein, 9 aa, Artificial Sequence
  source: /note="Description of Artificial Sequence: Synthetic peptide"
GGSGGGGSG

SEQ ID NO: 189 - protein, 112 aa, Artificial Sequence; identical to SEQ ID NO: 4
  source: /note="Description of Artificial Sequence: Synthetic polypeptide"

SEQ ID NO: 190 - protein, 105 aa, Artificial Sequence; identical to SEQ ID NO: 30
  source: /note="Description of Artificial Sequence: Synthetic polypeptide"

SEQ ID NO: 191 - protein, 253 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSGGGGSGGGGSQIQLVQSGPELKKPGETVMISCKASGYTFTNYGMNWVKQAPGKGLKWMGWINTYTGEPTYADDFKGRFAFSLETSASTAYLQINNLKNEDTATYFCARKFLTTVVVTDYAMDYWGQGTSVTVSS

SEQ ID NO: 192 - protein, 119 aa, Artificial Sequence; identical to SEQ ID NO: 3
  source: /note="Description of Artificial Sequence: Synthetic polypeptide"

SEQ ID NO: 193 - protein, 10 aa, Artificial Sequence
  source: /note="Description of Artificial Sequence: Synthetic peptide"
GGGGSGGGGS

SEQ ID NO: 194 - protein, 124 aa, Artificial Sequence; identical to SEQ ID NO: 182
  source: /note="Description of Artificial Sequence: Synthetic polypeptide"

SEQ ID NO: 195 - protein, 330 aa, Artificial Sequence; identical to SEQ ID NO: 25
  source: /note="Description of Artificial Sequence: Synthetic polypeptide"

SEQ ID NO: 196 - protein, 229 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGGGSGGGGSGDIQMTQTTSSLSASLGDRVTISCRASQDISNYLNWYQQKPDGTVKLLIYYTSRLQSGVPSRFSGSGSGTDYSLTISNLEQEDIATYFCQQGNTLPPTFGVGTKLELKR

SEQ ID NO: 197 - protein, 112 aa, Artificial Sequence; identical to SEQ ID NO: 4
  source: /note="Description of Artificial Sequence: Synthetic polypeptide"

SEQ ID NO: 198 - protein, 9 aa, Artificial Sequence
  source: /note="Description of Artificial Sequence: Synthetic peptide"
GGSGGGGSG

SEQ ID NO: 199 - protein, 108 aa, Artificial Sequence; identical to SEQ ID NO: 187
  source: /note="Description of Artificial Sequence: Synthetic polypeptide"

SEQ ID NO: 200 - protein, 106 aa, Artificial Sequence; identical to SEQ ID NO: 40
  source: /note="Description of Artificial Sequence: Synthetic polypeptide"

SEQ ID NO: 201 - protein, 249 aa, Artificial Sequence
  source: /note="Description of Artificial Sequence: Synthetic polypeptide"
QIQLVQSGPELKKPGETVMISCKASGYTFTNYGMNWVKQAPGKGLKWMGWINTYTGEPTYADDFKGRFAFSLETSASTAYLQINNLKNEDTATYFCARKFLTTVVVTDYAMDYWGQGTSVTVSSASTKGPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 202 - protein, 124 aa, Artificial Sequence; identical to SEQ ID NO: 182
  source: /note="Description of Artificial Sequence: Synthetic polypeptide"

SEQ ID NO: 203 - protein, 6 aa, Artificial Sequence
  source: /note="Description of Artificial Sequence: Synthetic peptide"
ASTKGP

SEQ ID NO: 204 - protein, 119 aa, Artificial Sequence; identical to SEQ ID NO: 3
  source: /note="Description of Artificial Sequence: Synthetic polypeptide"

SEQ ID NO: 205 - protein, 330 aa, Artificial Sequence; identical to SEQ ID NO: 25
  source: /note="Description of Artificial Sequence: Synthetic polypeptide"

SEQ ID NO: 206 - protein, 225 aa, Artificial Sequence
  source: /note="Description of Artificial Sequence: Synthetic polypeptide"
DIQMTQTTSSLSASLGDRVTISCRASQDISNYLNWYQQKPDGTVKLLIYYTSRLQSGVPSRFSGSGSGTDYSLTISNLEQEDIATYFCQQGNTLPPTFGVGTKLELKRTVAAPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 207 - protein, 108 aa, Artificial Sequence; identical to SEQ ID NO: 187
  source: /note="Description of Artificial Sequence: Synthetic polypeptide"

SEQ ID NO: 208 - protein, 5 aa, Artificial Sequence
  source: /note="Description of Artificial Sequence: Synthetic peptide"
TVAAP

SEQ ID NO: 209 - protein, 112 aa, Artificial Sequence; identical to SEQ ID NO: 4
  source: /note="Description of Artificial Sequence: Synthetic polypeptide"

SEQ ID NO: 210 - protein, 105 aa, Artificial Sequence; identical to SEQ ID NO: 30
  source: /note="Description of Artificial Sequence: Synthetic polypeptide"

SEQ ID NO: 211 - protein, 249 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPQIQLVQSGPELKKPGETVMISCKASGYTFTNYGMNWVKQAPGKGLKWMGWINTYTGEPTYADDFKGRFAFSLETSASTAYLQINNLKNEDTATYFCARKFLTTVVVTDYAMDYWGQGTSVTVSS

SEQ ID NO: 212 - protein, 119 aa, Artificial Sequence; identical to SEQ ID NO: 3
  source: /note="Description of Artificial Sequence: Synthetic polypeptide"

SEQ ID NO: 213 - protein, 6 aa, Artificial Sequence
  source: /note="Description of Artificial Sequence: Synthetic peptide"
ASTKGP

SEQ ID NO: 214 - protein, 124 aa, Artificial Sequence; identical to SEQ ID NO: 182
  source: /note="Description of Artificial Sequence: Synthetic polypeptide"

SEQ ID NO: 215 - protein, 330 aa, Artificial Sequence; identical to SEQ ID NO: 25
  source: /note="Description of Artificial Sequence: Synthetic polypeptide"

SEQ ID NO: 216 - protein, 226 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPDIQMTQTTSSLSASLGDRVTISCRASQDISNYLNWYQQKPDGTVKLLIYYTSRLQSGVPSRFSGSGSGTDYSLTISNLEQEDIATYFCQQGNTLPPTFGVGTKLELKR

SEQ ID NO: 217 - protein, 112 aa, Artificial Sequence; identical to SEQ ID NO: 4
  source: /note="Description of Artificial Sequence: Synthetic polypeptide"

SEQ ID NO: 218 - protein, 6 aa, Artificial Sequence
  source: /note="Description of Artificial Sequence: Synthetic peptide"
QPKAAP

SEQ ID NO: 219 - protein, 108 aa, Artificial Sequence; identical to SEQ ID NO: 187
  source: /note="Description of Artificial Sequence: Synthetic polypeptide"

SEQ ID NO: 220 - protein, 106 aa, Artificial Sequence; identical to SEQ ID NO: 40
  source: /note="Description of Artificial Sequence: Synthetic polypeptide"

SEQ ID NO: 221 - protein, 249 aa, Artificial Sequence; identical to SEQ ID NO: 201
  source: /note="Description of Artificial Sequence: Synthetic polypeptide"

SEQ ID NO: 222 - protein, 124 aa, Artificial Sequence; identical to SEQ ID NO: 182
  source: /note="Description of Artificial Sequence: Synthetic polypeptide"

SEQ ID NO: 223 - protein, 6 aa, Artificial Sequence
  source: /note="Description of Artificial Sequence: Synthetic peptide"
ASTKGP

SEQ ID NO: 224 - protein, 119 aa, Artificial Sequence; identical to SEQ ID NO: 3
  source: /note="Description of Artificial Sequence: Synthetic polypeptide"

SEQ ID NO: 225 - protein, 330 aa, Artificial Sequence; identical to SEQ ID NO: 25
  source: /note="Description of Artificial Sequence: Synthetic polypeptide"

SEQ ID NO: 226 - protein, 232 aa, Artificial Sequence
  source: /note="Description of Artificial Sequence: Synthetic polypeptide"
DIQMTQTTSSLSASLGDRVTISCRASQDISNYLNWYQQKPDGTVKLLIYYTSRLQSGVPSRFSGSGSGTDYSLTISNLEQEDIATYFCQQGNTLPPTFGVGTKLELKRTVAAPSVFIFPPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 227 - protein, 108 aa, Artificial Sequence; identical to SEQ ID NO: 187
  source: /note="Description of Artificial Sequence: Synthetic polypeptide"

SEQ ID NO: 228 - protein, 12 aa, Artificial Sequence
  source: /note="Description of Artificial Sequence: Synthetic peptide"
TVAAPSVFIFPP

SEQ ID NO: 229 - protein, 112 aa, Artificial Sequence; identical to SEQ ID NO: 4
  source: /note="Description of Artificial Sequence: Synthetic polypeptide"

SEQ ID NO: 230 - protein, 105 aa, Artificial Sequence; identical to SEQ ID NO: 30
  source: /note="Description of Artificial Sequence: Synthetic polypeptide"

SEQ ID NO: 231 - protein, 249 aa, Artificial Sequence; identical to SEQ ID NO: 211
  source: /note="Description of Artificial Sequence: Synthetic polypeptide"

SEQ ID NO: 232 - protein, 119 aa, Artificial Sequence; identical to SEQ ID NO: 3
  source: /note="Description of Artificial Sequence: Synthetic polypeptide"

SEQ ID NO: 233 - protein, 6 aa, Artificial Sequence
  source: /note="Description of Artificial Sequence: Synthetic peptide"
ASTKGP

SEQ ID NO: 234 - protein, 124 aa, Artificial Sequence; identical to SEQ ID NO: 182
  source: /note="Description of Artificial Sequence: Synthetic polypeptide"

SEQ ID NO: 235 - protein, 330 aa, Artificial Sequence; identical to SEQ ID NO: 25
  source: /note="Description of Artificial Sequence: Synthetic polypeptide"

SEQ ID NO: 236 - protein, 233 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPSVTLFPPDIQMTQTTSSLSASLGDRVTISCRASQDISNYLNWYQQKPDGTVKLLIYYTSRLQSGVPSRFSGSGSGTDYSLTISNLEQEDIATYFCQQGNTLPPTFGVGTKLELKR

SEQ ID NO: 237 - protein, 112 aa, Artificial Sequence; identical to SEQ ID NO: 4
  source: /note="Description of Artificial Sequence: Synthetic polypeptide"

SEQ ID NO: 238 - protein, 13 aa, Artificial Sequence
  source: /note="Description of Artificial Sequence: Synthetic peptide"
QPKAAPSVTLFPP

SEQ ID NO: 239 - protein, 108 aa, Artificial Sequence; identical to SEQ ID NO: 187
  source: /note="Description of Artificial Sequence: Synthetic polypeptide"

SEQ ID NO: 240 - protein, 106 aa, Artificial Sequence; identical to SEQ ID NO: 40
  source: /note="Description of Artificial Sequence: Synthetic polypeptide"

SEQ ID NO: 241 - protein, 256 aa, Artificial Sequence
  source: /note="Description of Artificial Sequence: Synthetic polypeptide"
QIQLVQSGPELKKPGETVMISCKASGYTFTNYGMNWVKQAPGKGLKWMGWINTYTGEPTYADDFKGRFAFSLETSASTAYLQINNLKNEDTATYFCARKFLTTVVVTDYAMDYWGQGTSVTVSSASTKGPSVFPLAPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 242 - protein, 124 aa, Artificial Sequence; identical to SEQ ID NO: 182
  source: /note="Description of Artificial Sequence: Synthetic polypeptide"

SEQ ID NO: 243 - protein, 13 aa, Artificial Sequence
  source: /note="Description of Artificial Sequence: Synthetic peptide"
ASTKGPSVFPLAP

SEQ ID NO: 244 - protein, 119 aa, Artificial Sequence; identical to SEQ ID NO: 3
  source: /note="Description of Artificial Sequence: Synthetic polypeptide"

SEQ ID NO: 245 - protein, 330 aa, Artificial Sequence; identical to SEQ ID NO: 25
  source: /note="Description of Artificial Sequence: Synthetic polypeptide"

SEQ ID NO: 246 - protein, 225 aa, Artificial Sequence; identical to SEQ ID NO: 206
  source: /note="Description of Artificial Sequence: Synthetic polypeptide"

SEQ ID NO: 247 - protein, 108 aa, Artificial Sequence; identical to SEQ ID NO: 187
  source: /note="Description of Artificial Sequence: Synthetic polypeptide"

SEQ ID NO: 248 - protein, 5 aa, Artificial Sequence
  source: /note="Description of Artificial Sequence: Synthetic peptide"
TVAAP

SEQ ID NO: 249 - protein, 112 aa, Artificial Sequence; identical to SEQ ID NO: 4
  source: /note="Description of Artificial Sequence: Synthetic polypeptide"

SEQ ID NO: 250 - protein, 105 aa, Artificial Sequence; identical to SEQ ID NO: 30
  source: /note="Description of Artificial Sequence: Synthetic polypeptide"

SEQ ID NO: 251 - protein, 256 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPSVFPLAPQIQLVQSGPELKKPGETVMISCKASGYTFTNYGMNWVKQAPGKGLKWMGWINTYTGEPTYADDFKGRFAFSLETSASTAYLQINNLKNEDTATYFCARKFLTTVVVTDYAMDYWGQGTSVTVSS

SEQ ID NO: 252 - protein, 119 aa, Artificial Sequence; identical to SEQ ID NO: 3
  source: /note="Description of Artificial Sequence: Synthetic polypeptide"

SEQ ID NO: 253 - protein, 13 aa, Artificial Sequence
  source: /note="Description of Artificial Sequence: Synthetic peptide"
ASTKGPSVFPLAP

SEQ ID NO: 254 - protein, 124 aa, Artificial Sequence; identical to SEQ ID NO: 182
  source: /note="Description of Artificial Sequence: Synthetic polypeptide"

SEQ ID NO: 255 - protein, 330 aa, Artificial Sequence; identical to SEQ ID NO: 25
  source: /note="Description of Artificial Sequence: Synthetic polypeptide"

SEQ ID NO: 256 - protein, 226 aa, Artificial Sequence; identical to SEQ ID NO: 216
  source: /note="Description of Artificial Sequence: Synthetic polypeptide"

SEQ ID NO: 257 - protein, 112 aa, Artificial Sequence; identical to SEQ ID NO: 4
  source: /note="Description of Artificial Sequence: Synthetic polypeptide"

SEQ ID NO: 258 - protein, 6 aa, Artificial Sequence
  source: /note="Description of Artificial Sequence: Synthetic peptide"
QPKAAP

SEQ ID NO: 259 - protein, 108 aa, Artificial Sequence; identical to SEQ ID NO: 187
  source: /note="Description of Artificial Sequence: Synthetic polypeptide"

SEQ ID NO: 260 - protein, 106 aa, Artificial Sequence; identical to SEQ ID NO: 40
  source: /note="Description of Artificial Sequence: Synthetic polypeptide"

SEQ ID NO: 261 - protein, 246 aa, Artificial Sequence
  source: /note="Description of Artificial Sequence: Synthetic polypeptide"
QVQLKESGPGLVAPSQSLSITCTVSGFSLTDYGVNWVRQPPGKGLEWLGMIWGDGSTDYDSTLKSRLSISKDNSKSQIFLKMNSLQTDDTARYYCAREWHHGPVAYWGQGTLVTVSAGGGGSGGGGSEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 262 - protein, 117 aa, Artificial Sequence
  source: /note="Description of Artificial Sequence: Synthetic polypeptide"
QVQLKESGPGLVAPSQSLSITCTVSGFSLTDYGVNWVRQPPGKGLEWLGMIWGDGSTDYDSTLKSRLSISKDNSKSQIFLKMNSLQTDDTARYYCAREWHHGPVAYWGQGTLVTVSA

SEQ ID NO: 263 - protein, 10 aa, Artificial Sequence
  source: /note="Description of Artificial Sequence: Synthetic peptide"
GGGGSGGGGS

SEQ ID NO: 264 - protein, 119 aa, Artificial Sequence; identical to SEQ ID NO: 3
  source: /note="Description of Artificial Sequence: Synthetic polypeptide"

SEQ ID NO: 265 - protein, 330 aa, Artificial Sequence; identical to SEQ ID NO: 25
  source: /note="Description of Artificial Sequence: Synthetic polypeptide"

SEQ ID NO: 266 - protein, 229 aa, Artificial Sequence
  source: /note="Description of Artificial Sequence: Synthetic polypeptide"
DIVMTQSHKFMSTTVGDRVSITCKASQAVSSAVAWYQQKPGQSPKLLIYWASTRHTGVPDRFTGSGSVTDFTLTIHNLQAEDLALYYCQQHYSTPFTFGSGTKLEIKRGGSGGGGSGQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 267 - protein, 108 aa, Artificial Sequence
  source: /note="Description of Artificial Sequence: Synthetic polypeptide"
DIVMTQSHKFMSTTVGDRVSITCKASQAVSSAVAWYQQKPGQSPKLLIYWASTRHTGVPDRFTGSGSVTDFTLTIHNLQAEDLALYYCQQHYSTPFTFGSGTKLEIKR

SEQ ID NO: 268 - protein, 9 aa, Artificial Sequence
  source: /note="Description of Artificial Sequence: Synthetic peptide"
GGSGGGGSG

SEQ ID NO: 269 - protein, 112 aa, Artificial Sequence; identical to SEQ ID NO: 4
  source: /note="Description of Artificial Sequence: Synthetic polypeptide"

SEQ ID NO: 270 - protein, 105 aa, Artificial Sequence; identical to SEQ ID NO: 30
  source: /note="Description of Artificial Sequence: Synthetic polypeptide"

SEQ ID NO: 271 - protein, 246 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSGGGGSGGGGSQVQLKESGPGLVAPSQSLSITCTVSGFSLTDYGVNWVRQPPGKGLEWLGMIWGDGSTDYDSTLKSRLSISKDNSKSQIFLKMNSLQTDDTARYYCAREWHHGPVAYWGQGTLVTVSA

SEQ ID NO: 272 - protein, 119 aa, Artificial Sequence; identical to SEQ ID NO: 3
  source: /note="Description of Artificial Sequence: Synthetic polypeptide"

SEQ ID NO: 273 - protein, 10 aa, Artificial Sequence
  source: /note="Description of Artificial Sequence: Synthetic peptide"
GGGGSGGGGS

SEQ ID NO: 274 - protein, 117 aa, Artificial Sequence; identical to SEQ ID NO: 262
  source: /note="Description of Artificial Sequence: Synthetic polypeptide"

SEQ ID NO: 275 - protein, 330 aa, Artificial Sequence; identical to SEQ ID NO: 25
  source: /note="Description of Artificial Sequence: Synthetic polypeptide"

SEQ ID NO: 276 - protein, 229 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGGGSGGGGSGDIVMTQSHKFMSTTVGDRVSITCKASQAVSSAVAWYQQKPGQSPKLLIYWASTRHTGVPDRFTGSGSVTDFTLTIHNLQAEDLALYYCQQHYSTPFTFGSGTKLEIKR

SEQ ID NO: 277 - protein, 112 aa, Artificial Sequence; identical to SEQ ID NO: 4
  source: /note="Description of Artificial Sequence: Synthetic polypeptide"

SEQ ID NO: 278 - protein, 9 aa, Artificial Sequence
  source: /note="Description of Artificial Sequence: Synthetic peptide"
GGSGGGGSG

SEQ ID NO: 279 - protein, 108 aa, Artificial Sequence; identical to SEQ ID NO: 267
  source: /note="Description of Artificial Sequence: Synthetic polypeptide"

SEQ ID NO: 280 - protein, 106 aa, Artificial Sequence; identical to SEQ ID NO: 40
  source: /note="Description of Artificial Sequence: Synthetic polypeptide"

SEQ ID NO: 281 - protein, 242 aa, Artificial Sequence
  source: /note="Description of Artificial Sequence: Synthetic polypeptide"
QVQLKESGPGLVAPSQSLSITCTVSGFSLTDYGVNWVRQPPGKGLEWLGMIWGDGSTDYDSTLKSRLSISKDNSKSQIFLKMNSLQTDDTARYYCAREWHHGPVAYWGQGTLVTVSAASTKGPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 282 - protein, 117 aa, Artificial Sequence; identical to SEQ ID NO: 262
  source: /note="Description of Artificial Sequence: Synthetic polypeptide"

SEQ ID NO: 283 - protein, 6 aa, Artificial Sequence
  source: /note="Description of Artificial Sequence: Synthetic peptide"
ASTKGP

SEQ ID NO: 284 - protein, 119 aa, Artificial Sequence; identical to SEQ ID NO: 3
  source: /note="Description of Artificial Sequence: Synthetic polypeptide"

SEQ ID NO: 285 - protein, 330 aa, Artificial Sequence; identical to SEQ ID NO: 25
  source: /note="Description of Artificial Sequence: Synthetic polypeptide"

SEQ ID NO: 286 - protein, 225 aa, Artificial Sequence
  source: /note="Description of Artificial Sequence: Synthetic polypeptide"
DIVMTQSHKFMSTTVGDRVSITCKASQAVSSAVAWYQQKPGQSPKLLIYWASTRHTGVPDRFTGSGSVTDFTLTIHNLQAEDLALYYCQQHYSTPFTFGSGTKLEIKRTVAAPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 287 - protein, 108 aa, Artificial Sequence; identical to SEQ ID NO: 267
  source: /note="Description of Artificial Sequence: Synthetic polypeptide"

SEQ ID NO: 288 - protein, 5 aa, Artificial Sequence
  source: /note="Description of Artificial Sequence: Synthetic peptide"
TVAAP

SEQ ID NO: 289 - protein, 112 aa, Artificial Sequence; identical to SEQ ID NO: 4
  source: /note="Description of Artificial Sequence: Synthetic polypeptide"

SEQ ID NO: 290 - protein, 105 aa, Artificial Sequence; identical to SEQ ID NO: 30
  source: /note="Description of Artificial Sequence: Synthetic polypeptide"

SEQ ID NO: 291 - protein, 242 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPQVQLKESGPGLVAPSQSLSITCTVSGFSLTDYGVNWVRQPPGKGLEWLGMIWGDGSTDYDSTLKSRLSISKDNSKSQIFLKMNSLQTDDTARYYCAREWHHGPVAYWGQGTLVTVSA

SEQ ID NO: 292 - protein, 119 aa, Artificial Sequence; identical to SEQ ID NO: 3
  source: /note="Description of Artificial Sequence: Synthetic polypeptide"

SEQ ID NO: 293 - protein, 6 aa, Artificial Sequence
  source: /note="Description of Artificial Sequence: Synthetic peptide"
ASTKGP

SEQ ID NO: 294 - protein, 117 aa, Artificial Sequence; identical to SEQ ID NO: 262
  source: /note="Description of Artificial Sequence: Synthetic polypeptide"

SEQ ID NO: 295 - protein, 330 aa, Artificial Sequence; identical to SEQ ID NO: 25
  source: /note="Description of Artificial Sequence: Synthetic polypeptide"

SEQ ID NO: 296 - protein, 226 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPDIVMTQSHKFMSTTVGDRVSITCKASQAVSSAVAWYQQKPGQSPKLLIYWASTRHTGVPDRFTGSGSVTDFTLTIHNLQAEDLALYYCQQHYSTPFTFGSGTKLEIKR

SEQ ID NO: 297 - protein, 112 aa, Artificial Sequence; identical to SEQ ID NO: 4
  source: /note="Description of Artificial Sequence: Synthetic polypeptide"

SEQ ID NO: 298 - protein, 6 aa, Artificial Sequence
  source: /note="Description of Artificial Sequence: Synthetic peptide"
QPKAAP

SEQ ID NO: 299 - protein, 108 aa, Artificial Sequence; identical to SEQ ID NO: 267
  source: /note="Description of Artificial Sequence: Synthetic polypeptide"

SEQ ID NO: 300 - protein, 106 aa, Artificial Sequence; identical to SEQ ID NO: 40
  source: /note="Description of Artificial Sequence: Synthetic polypeptide"

SEQ ID NO: 301 - protein, 250 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 302 - protein, 121 aa, Artificial Sequence [sequence omitted]

SEQ ID NO: 303 - protein, 10 aa, Artificial Sequence
  source: /note="Description of Artificial Sequence: Synthetic peptide"
GGGGSGGGGS

SEQ ID NO: 304 - protein, 119 aa, Artificial Sequence; identical to SEQ ID NO: 3
  source: /note="Description of Artificial Sequence: Synthetic polypeptide"

SEQ ID NO: 305 - protein, 330 aa, Artificial Sequence; identical to SEQ ID NO: 25
  source: /note="Description of Artificial Sequence: Synthetic polypeptide"

SEQ ID NO: 306 - protein, 229 aa, Artificial Sequence
  source: /note="Description of Artificial Sequence: Synthetic polypeptide"
DIQMTQSPSSLSASVGDRVTITCRASGGIRNYLGWYQQKPGKAPKLLIYAASTLQSGVPSRFSGSGSGTDFTLTISSLQPEDVATYYCQRYNRAPYTFGQGTKVEIKRGGSGGGGSGQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 307 - protein, 108 aa, Artificial Sequence
  source: /note="Description of Artificial Sequence: Synthetic polypeptide"
DIQMTQSPSSLSASVGDRVTITCRASGGIRNYLGWYQQKPGKAPKLLIYAASTLQSGVPSRFSGSGSGTDFTLTISSLQPEDVATYYCQRYNRAPYTFGQGTKVEIKR

SEQ ID NO: 308 - protein, 9 aa, Artificial Sequence
  source: /note="Description of Artificial Sequence: Synthetic peptide"
GGSGGGGSG

SEQ ID NO: 309 - protein, 112 aa, Artificial Sequence; identical to SEQ ID NO: 4
  source: /note="Description of Artificial Sequence: Synthetic polypeptide"

SEQ ID NO: 310 - protein, 105 aa, Artificial Sequence; identical to SEQ ID NO: 30
  source: /note="Description of Artificial Sequence: Synthetic polypeptide"

SEQ ID NO: 311 - protein, 250 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS

SEQ ID NO: 312 - protein, 119 aa, Artificial Sequence; identical to SEQ ID NO: 3
  source: /note="Description of Artificial Sequence: Synthetic polypeptide"

SEQ ID NO: 313 - protein, 10 aa, Artificial Sequence
  source: /note="Description of Artificial Sequence: Synthetic peptide"
GGGGSGGGGS

SEQ ID NO: 314 - protein, 121 aa, Artificial Sequence [sequence omitted]

SEQ ID NO: 315 - protein, 330 aa, Artificial Sequence; identical to SEQ ID NO: 25
  source: /note="Description of Artificial Sequence: Synthetic polypeptide"

SEQ ID NO: 316 - protein, 229 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGGGSGGGGSGDIQMTQSPSSLSASVGDRVTITCRASGGIRNYLGWYQQKPGKAPKLLIYAASTLQSGVPSRFSGSGSGTDFTLTISSLQPEDVATYYCQRYNRAPYTFGQGTKVEIKR

SEQ ID NO: 317 - protein, 112 aa, Artificial Sequence; identical to SEQ ID NO: 4
  source: /note="Description of Artificial Sequence: Synthetic polypeptide"

SEQ ID NO: 318 - protein, 9 aa, Artificial Sequence
  source: /note="Description of Artificial Sequence: Synthetic peptide"
GGSGGGGSG

SEQ ID NO: 319 - protein, 108 aa, Artificial Sequence; identical to SEQ ID NO: 307
  source: /note="Description of Artificial Sequence: Synthetic polypeptide"

SEQ ID NO: 320 - protein, 106 aa, Artificial Sequence; identical to SEQ ID NO: 40
  source: /note="Description of Artificial Sequence: Synthetic polypeptide"

SEQ ID NO: 321 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 322 - protein, 121 aa, Artificial Sequence [sequence omitted]

SEQ ID NO: 323 - protein, 6 aa, Artificial Sequence
  source: /note="Description of Artificial Sequence: Synthetic peptide"
ASTKGP

SEQ ID NO: 324 - protein, 119 aa, Artificial Sequence; identical to SEQ ID NO: 3
  source: /note="Description of Artificial Sequence: Synthetic polypeptide"

SEQ ID NO: 325 - protein, 330 aa, Artificial Sequence; identical to SEQ ID NO: 25
  source: /note="Description of Artificial Sequence: Synthetic polypeptide"

SEQ ID NO: 326 - protein, 225 aa, Artificial Sequence
  source: /note="Description of Artificial Sequence: Synthetic polypeptide"
DIQMTQSPSSLSASVGDRVTITCRASGGIRNYLGWYQQKPGKAPKLLIYAASTLQSGVPSRFSGSGSGTDFTLTISSLQPEDVATYYCQRYNRAPYTFGQGTKVEIKRTVAAPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 327 - protein, 108 aa, Artificial Sequence; identical to SEQ ID NO: 307
  source: /note="Description of Artificial Sequence: Synthetic polypeptide"

SEQ ID NO: 328 - protein, 5 aa, Artificial Sequence
  source: /note="Description of Artificial Sequence: Synthetic peptide"
TVAAP

SEQ ID NO: 329 - protein, 112 aa, Artificial Sequence; identical to SEQ ID NO: 4
  source: /note="Description of Artificial Sequence: Synthetic polypeptide"

SEQ ID NO: 330 - protein, 105 aa, Artificial Sequence; identical to SEQ ID NO: 30
  source: /note="Description of Artificial Sequence: Synthetic polypeptide"

SEQ ID NO: 331 - protein, 246 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS

SEQ ID NO: 332 - protein, 119 aa, Artificial Sequence; identical to SEQ ID NO: 3
  source: /note="Description of Artificial Sequence: Synthetic polypeptide"

SEQ ID NO: 333 - protein, 6 aa, Artificial Sequence
  source: /note="Description of Artificial Sequence: Synthetic peptide"
ASTKGP

SEQ ID NO: 334 - protein, 121 aa, Artificial Sequence [sequence omitted]

SEQ ID NO: 335 - protein, 330 aa, Artificial Sequence; identical to SEQ ID NO: 25
  source: /note="Description of Artificial Sequence: Synthetic polypeptide"

SEQ ID NO: 336 - protein, 226 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPDIQMTQSPSSLSASVGDRVTITCRASGGIRNYLGWYQQKPGKAPKLLIYAASTLQSGVPSRFSGSGSGTDFTLTISSLQPEDVATYYCQRYNRAPYTFGQGTKVEIKR

SEQ ID NO: 337 - protein, 112 aa, Artificial Sequence; identical to SEQ ID NO: 4
  source: /note="Description of Artificial Sequence: Synthetic polypeptide"

SEQ ID NO: 338 - protein, 6 aa, Artificial Sequence
  source: /note="Description of Artificial Sequence: Synthetic peptide"
QPKAAP

SEQ ID NO: 339 - protein, 108 aa, Artificial Sequence; identical to SEQ ID NO: 307
  source: /note="Description of Artificial Sequence: Synthetic polypeptide"

SEQ ID NO: 340 - protein, 106 aa, Artificial Sequence; identical to SEQ ID NO: 40
  source: /note="Description of Artificial Sequence: Synthetic polypeptide"

SEQ ID NO: 341 - protein, 246 aa, Artificial Sequence; identical to SEQ ID NO: 321
  source: /note="Description of Artificial Sequence: Synthetic polypeptide"

SEQ ID NO: 342 - protein, 121 aa, Artificial Sequence [sequence omitted]

SEQ ID NO: 343 - protein, 6 aa, Artificial Sequence
  source: /note="Description of Artificial Sequence: Synthetic peptide"
ASTKGP

SEQ ID NO: 344 - protein, 119 aa, Artificial Sequence; identical to SEQ ID NO: 3
  source: /note="Description of Artificial Sequence: Synthetic polypeptide"

SEQ ID NO: 345 - protein, 330 aa, Artificial Sequence; identical to SEQ ID NO: 25
  source: /note="Description of Artificial Sequence: Synthetic polypeptide"

SEQ ID NO: 346 - protein, 232 aa, Artificial Sequence
  source: /note="Description of Artificial Sequence: Synthetic polypeptide"
DIQMTQSPSSLSASVGDRVTITCRASGGIRNYLGWYQQKPGKAPKLLIYAASTLQSGVPSRFSGSGSGTDFTLTISSLQPEDVATYYCQRYNRAPYTFGQGTKVEIKRTVAAPSVFIFPPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 347 - protein, 108 aa, Artificial Sequence; identical to SEQ ID NO: 307
  source: /note="Description of Artificial Sequence: Synthetic polypeptide"

SEQ ID NO: 348 - protein, 12 aa, Artificial Sequence
  source: /note="Description of Artificial Sequence: Synthetic peptide"
TVAAPSVFIFPP

SEQ ID NO: 349 - protein, 112 aa, Artificial Sequence; identical to SEQ ID NO: 4
  source: /note="Description of Artificial Sequence: Synthetic polypeptide"

SEQ ID NO: 350 - protein, 105 aa, Artificial Sequence; identical to SEQ ID NO: 30
  source: /note="Description of Artificial Sequence: Synthetic polypeptide"

SEQ ID NO: 351 - protein, 246 aa, Artificial Sequence; identical to SEQ ID NO: 331
  source: /note="Description of Artificial Sequence: Synthetic polypeptide"

SEQ ID NO: 352 - protein, 119 aa, Artificial Sequence; identical to SEQ ID NO: 3
  source: /note="Description of Artificial Sequence: Synthetic polypeptide"

SEQ ID NO: 353 - protein, 6 aa, Artificial Sequence
  source: /note="Description of Artificial Sequence: Synthetic peptide"
ASTKGP

SEQ ID NO: 354 - protein, 121 aa, Artificial Sequence [sequence omitted]

SEQ ID NO: 355 - protein, 330 aa, Artificial Sequence; identical to SEQ ID NO: 25
  source: /note="Description of Artificial Sequence: Synthetic polypeptide"

SEQ ID NO: 356 - protein, 233 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPSVTLFPPDIQMTQSPSSLSASVGDRVTITCRASGGIRNYLGWYQQKPGKAPKLLIYAASTLQSGVPSRFSGSGSGTDFTLTISSLQPEDVATYYCQRYNRAPYTFGQGTKVEIKR

SEQ ID NO: 357 - protein, 112 aa, Artificial Sequence; identical to SEQ ID NO: 4
  source: /note="Description of Artificial Sequence: Synthetic polypeptide"

SEQ ID NO: 358 - protein, 13 aa, Artificial Sequence
  source: /note="Description of Artificial Sequence: Synthetic peptide"
QPKAAPSVTLFPP

SEQ ID NO: 359 - protein, 108 aa, Artificial Sequence; identical to SEQ ID NO: 307
  source: /note="Description of Artificial Sequence: Synthetic polypeptide"

SEQ ID NO: 360 - protein, 106 aa, Artificial Sequence; identical to SEQ ID NO: 40
  source: /note="Description of Artificial Sequence: Synthetic polypeptide"

SEQ ID NO: 361 - protein, 253 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPEVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSS

SEQ ID NO: 362 - protein, 121 aa, Artificial Sequence [sequence omitted]

SEQ ID NO: 363 - protein, 13 aa, Artificial Sequence
  source: /note="Description of Artificial Sequence: Synthetic peptide"
ASTKGPSVFPLAP

SEQ ID NO: 364 - protein, 119 aa, Artificial Sequence; identical to SEQ ID NO: 3
  source: /note="Description of Artificial Sequence: Synthetic polypeptide"

SEQ ID NO: 365 - protein, 330 aa, Artificial Sequence; identical to SEQ ID NO: 25
  source: /note="Description of Artificial Sequence: Synthetic polypeptide"

SEQ ID NO: 366 - protein, 225 aa, Artificial Sequence; identical to SEQ ID NO: 326
  source: /note="Description of Artificial Sequence: Synthetic polypeptide"

SEQ ID NO: 367 - protein, 108 aa, Artificial Sequence; identical to SEQ ID NO: 307
  source: /note="Description of Artificial Sequence: Synthetic polypeptide"

SEQ ID NO: 368 - protein, 5 aa, Artificial Sequence
  source: /note="Description of Artificial Sequence: Synthetic peptide"
TVAAP

SEQ ID NO: 369 - protein, 112 aa, Artificial Sequence; identical to SEQ ID NO: 4
  source: /note="Description of Artificial Sequence: Synthetic polypeptide"

SEQ ID NO: 370 - protein, 105 aa, Artificial Sequence; identical to SEQ ID NO: 30
  source: /note="Description of Artificial Sequence: Synthetic polypeptide"

SEQ ID NO: 371 - protein, 253 aa, Artificial Sequence
  source: /note="Description of Artificial Sequence: Synthetic polypeptide"
EVQLVESGGGLVQPGGSLRLSCTASGFTFDDYALHWVRQAPGKGLEWVSGISWHGDFIDYADSVKGRFTISRDNSKNTLYLQMNGLRVEDMAIYYCAGNNRGYGGLDVWGQGTTVTVSSASTKGPSVFPLAPEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS

SEQ ID NO: 372 - protein, 119 aa, Artificial Sequence; identical to SEQ ID NO: 3
  source: /note="Description of Artificial Sequence: Synthetic polypeptide"

SEQ ID NO: 373 - protein, 13 aa, Artificial Sequence
  source: /note="Description of Artificial Sequence: Synthetic peptide"
ASTKGPSVFPLAP

SEQ ID NO: 374 - protein, 121 aa, Artificial Sequence [sequence omitted]

SEQ ID NO: 375 - protein, 330 aa, Artificial Sequence; identical to SEQ ID NO: 25
  source: /note="Description of Artificial Sequence: Synthetic polypeptide"

SEQ ID NO: 376 - protein, 226 aa, Artificial Sequence; identical to SEQ ID NO: 336
  source: /note="Description of Artificial Sequence: Synthetic polypeptide"

SEQ ID NO: 377 - protein, 112 aa, Artificial Sequence; identical to SEQ ID NO: 4
  source: /note="Description of Artificial Sequence: Synthetic polypeptide"

SEQ ID NO: 378 - protein, 6 aa, Artificial Sequence
  source: /note="Description of Artificial Sequence: Synthetic peptide"
QPKAAP

SEQ ID NO: 379 - protein, 108 aa, Artificial Sequence; identical to SEQ ID NO: 307
  source: /note="Description of Artificial Sequence: Synthetic polypeptide"

SEQ ID NO: 380 - protein, 106 aa, Artificial Sequence; identical to SEQ ID NO: 40
  source: /note="Description of Artificial Sequence: Synthetic polypeptide"

SEQ ID NO: 381 - protein, 250 aa, Artificial Sequence; identical to SEQ ID NO: 301
  source: /note="Description of Artificial Sequence: Synthetic polypeptide"

SEQ ID NO: 382 - protein, 121 aa, Artificial Sequence [sequence omitted]

SEQ ID NO: 383 - protein, 10 aa, Artificial Sequence
  source: /note="Description of Artificial Sequence: Synthetic peptide"
GGGGSGGGGS

SEQ ID NO: 384 - protein, 119 aa, Artificial Sequence; identical to SEQ ID NO: 3
  source: /note="Description of Artificial Sequence: Synthetic polypeptide"

SEQ ID NO: 385 - protein, 330 aa, Artificial Sequence; identical to SEQ ID NO: 25
  source: /note="Description of Artificial Sequence: Synthetic polypeptide"

SEQ ID NO: 386 - protein, 229 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRGGSGGGGSGQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 387 - protein, 108 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKR

SEQ ID NO: 388 - protein, 9 aa, Artificial Sequence
  source: /note="Description of Artificial Sequence: Synthetic peptide"
GGSGGGGSG

SEQ ID NO: 389 - protein, 112 aa, Artificial Sequence; identical to SEQ ID NO: 4
  source: /note="Description of Artificial Sequence: Synthetic polypeptide"

SEQ ID NO: 390 - protein, 105 aa, Artificial Sequence; identical to SEQ ID NO: 30
  source: /note="Description of Artificial Sequence: Synthetic polypeptide"

SEQ ID NO: 391 - protein, 250 aa, Artificial Sequence; identical to SEQ ID NO: 311
  source: /note="Description of Artificial Sequence: Synthetic polypeptide"

SEQ ID NO: 392 - protein, 119 aa, Artificial Sequence; identical to SEQ ID NO: 3
  source: /note="Description of Artificial Sequence: Synthetic polypeptide"

SEQ ID NO: 393 - protein, 10 aa, Artificial Sequence
  source: /note="Description of Artificial Sequence: Synthetic peptide"
GGGGSGGGGS

SEQ ID NO: 394 - protein, 121 aa, Artificial Sequence [sequence omitted]

SEQ ID NO: 395 - protein, 330 aa, Artificial Sequence; identical to SEQ ID NO: 25
  source: /note="Description of Artificial Sequence: Synthetic polypeptide"

SEQ ID NO: 396 - protein, 229 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGGGSGGGGSGDIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKR

SEQ ID NO: 397 - protein, 112 aa, Artificial Sequence; identical to SEQ ID NO: 4
  source: /note="Description of Artificial Sequence: Synthetic polypeptide"

SEQ ID NO: 398 - protein, 9 aa, Artificial Sequence
  source: /note="Description of Artificial Sequence: Synthetic peptide"
GGSGGGGSG

SEQ ID NO: 399 - protein, 108 aa, Artificial Sequence; identical to SEQ ID NO: 387
  source: /note="Description of Artificial Sequence: Synthetic polypeptide"

SEQ ID NO: 400 - protein, 106 aa, Artificial Sequence; identical to SEQ ID NO: 40
  source: /note="Description of Artificial Sequence: Synthetic polypeptide"

SEQ ID NO: 401 - protein, 246 aa, Artificial Sequence; identical to SEQ ID NO: 321
  source: /note="Description of Artificial Sequence: Synthetic polypeptide"

SEQ ID NO: 402 - protein, 121 aa, Artificial Sequence [sequence omitted]

SEQ ID NO: 403 - protein, 6 aa, Artificial Sequence
  source: /note="Description of Artificial Sequence: Synthetic peptide"
ASTKGP

SEQ ID NO: 404 - protein, 119 aa, Artificial Sequence; identical to SEQ ID NO: 3
  source: /note="Description of Artificial Sequence: Synthetic polypeptide"

SEQ ID NO: 405 - protein, 330 aa, Artificial Sequence; identical to SEQ ID NO: 25
  source: /note="Description of Artificial Sequence: Synthetic polypeptide"

SEQ ID NO: 406 - protein, 225 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 407 - protein, 108 aa, Artificial Sequence; identical to SEQ ID NO: 387
  source: /note="Description of Artificial Sequence: Synthetic polypeptide"

SEQ ID NO: 408 - protein, 5 aa, Artificial Sequence
  source: /note="Description of Artificial Sequence: Synthetic peptide"
TVAAP

SEQ ID NO: 409 - protein, 112 aa, Artificial Sequence; identical to SEQ ID NO: 4
  source: /note="Description of Artificial Sequence: Synthetic polypeptide"

SEQ ID NO: 410 - protein, 105 aa, Artificial Sequence; identical to SEQ ID NO: 30
  source: /note="Description of Artificial Sequence: Synthetic polypeptide"

SEQ ID NO: 411 - protein, 246 aa, Artificial Sequence; identical to SEQ ID NO: 331
  source: /note="Description of Artificial Sequence: Synthetic polypeptide"

SEQ ID NO: 412 - protein, 119 aa, Artificial Sequence; identical to SEQ ID NO: 3
  source: /note="Description of Artificial Sequence: Synthetic polypeptide"

SEQ ID NO: 413 - protein, 6 aa, Artificial Sequence
  source: /note="Description of Artificial Sequence: Synthetic peptide"
ASTKGP

SEQ ID NO: 414 - protein, 121 aa, Artificial Sequence [sequence omitted]

SEQ ID NO: 415 - protein, 330 aa, Artificial Sequence; identical to SEQ ID NO: 25
  source: /note="Description of Artificial Sequence: Synthetic polypeptide"

SEQ ID NO: 416 - protein, 226 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPDIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKR

SEQ ID NO: 417 - protein, 112 aa, Artificial Sequence; identical to SEQ ID NO: 4
  source: /note="Description of Artificial Sequence: Synthetic polypeptide"

SEQ ID NO: 418 - protein, 6 aa, Artificial Sequence
  source: /note="Description of Artificial Sequence: Synthetic peptide"
QPKAAP

SEQ ID NO: 419 - protein, 108 aa, Artificial Sequence; identical to SEQ ID NO: 387
  source: /note="Description of Artificial Sequence: Synthetic polypeptide"

SEQ ID NO: 420 - skipped

SEQ ID NO: 421 - protein, 246 aa, Artificial Sequence; identical to SEQ ID NO: 321
  source: /note="Description of Artificial Sequence: Synthetic polypeptide"

SEQ ID NO: 422 - protein, 121 aa, Artificial Sequence [sequence omitted]

SEQ ID NO: 423 - protein, 6 aa, Artificial Sequence
  source: /note="Description of Artificial Sequence: Synthetic peptide"
ASTKGP

SEQ ID NO: 424 - protein, 119 aa, Artificial Sequence; identical to SEQ ID NO: 3
  source: /note="Description of Artificial Sequence: Synthetic polypeptide"

SEQ ID NO: 425 - protein, 330 aa, Artificial Sequence; identical to SEQ ID NO: 25
  source: /note="Description of Artificial Sequence: Synthetic polypeptide"

SEQ ID NO: 426 - protein, 232 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPSVFIFPPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 427 - protein, 108 aa, Artificial Sequence; identical to SEQ ID NO: 387
  source: /note="Description of Artificial Sequence: Synthetic polypeptide"

SEQ ID NO: 428 - protein, 12 aa, Artificial Sequence
  source: /note="Description of Artificial Sequence: Synthetic peptide"
TVAAPSVFIFPP

SEQ ID NO: 429 - protein, 112 aa, Artificial Sequence; identical to SEQ ID NO: 4
  source: /note="Description of Artificial Sequence: Synthetic polypeptide"

SEQ ID NO: 430 - protein, 105 aa, Artificial Sequence; identical to SEQ ID NO: 30
  source: /note="Description of Artificial Sequence: Synthetic polypeptide"

SEQ ID NO: 431 - protein, 246 aa, Artificial Sequence; identical to SEQ ID NO: 331
  source: /note="Description of Artificial Sequence: Synthetic polypeptide"

SEQ ID NO: 432 - protein, 119 aa, Artificial Sequence; identical to SEQ ID NO: 3
  source: /note="Description of Artificial Sequence: Synthetic polypeptide"

SEQ ID NO: 433 - protein, 6 aa, Artificial Sequence
  source: /note="Description of Artificial Sequence: Synthetic peptide"
ASTKGP

SEQ ID NO: 434 - protein, 121 aa, Artificial Sequence [sequence omitted]

SEQ ID NO: 435 - protein, 330 aa, Artificial Sequence; identical to SEQ ID NO: 25
  source: /note="Description of Artificial Sequence: Synthetic polypeptide"

SEQ ID NO: 436 - protein, 233 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPSVTLFPPDIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKR

SEQ ID NO: 437 - protein, 112 aa, Artificial Sequence; identical to SEQ ID NO: 4
  source: /note="Description of Artificial Sequence: Synthetic polypeptide"

SEQ ID NO: 438 - protein, 13 aa, Artificial Sequence
  source: /note="Description of Artificial Sequence: Synthetic peptide"
QPKAAPSVTLFPP

SEQ ID NO: 439 - protein, 108 aa, Artificial Sequence; identical to SEQ ID NO: 387
  source: /note="Description of Artificial Sequence: Synthetic polypeptide"

SEQ ID NO: 440 - protein, 106 aa, Artificial Sequence; identical to SEQ ID NO: 40
  source: /note="Description of Artificial Sequence: Synthetic polypeptide"

SEQ ID NO: 441 - protein, 253 aa, Artificial Sequence; identical to SEQ ID NO: 361
  source: /note="Description of Artificial Sequence: Synthetic polypeptide"

SEQ ID NO: 442 - protein, 121 aa, Artificial Sequence [sequence omitted]

SEQ ID NO: 443 - protein, 13 aa, Artificial Sequence
  source: /note="Description of Artificial Sequence: Synthetic peptide"
ASTKGPSVFPLAP

SEQ ID NO: 444 - protein, 119 aa, Artificial Sequence; identical to SEQ ID NO: 3
  source: /note="Description of Artificial Sequence: Synthetic polypeptide"

SEQ ID NO: 445 - protein, 330 aa, Artificial Sequence; identical to SEQ ID NO: 25
  source: /note="Description of Artificial Sequence: Synthetic polypeptide"

SEQ ID NO: 446 - protein, 225 aa, Artificial Sequence; identical to SEQ ID NO: 406
  source: /note="Description of Artificial Sequence: Synthetic polypeptide"

SEQ ID NO: 447 - protein, 108 aa, Artificial Sequence; identical to SEQ ID NO: 387
  source: /note="Description of Artificial Sequence: Synthetic polypeptide"

SEQ ID NO: 448 - protein, 5 aa, Artificial Sequence
  source: /note="Description of Artificial Sequence: Synthetic peptide"
TVAAP

SEQ ID NO: 449 - protein, 112 aa, Artificial Sequence; identical to SEQ ID NO: 4
  source: /note="Description of Artificial Sequence: Synthetic polypeptide"

SEQ ID NO: 450 - protein, 105 aa, Artificial Sequence; identical to SEQ ID NO: 30
  source: /note="Description of Artificial Sequence: Synthetic polypeptide"

SEQ ID NO: 451 - protein, 253 aa, Artificial Sequence; identical to SEQ ID NO: 371
  source: /note="Description of Artificial Sequence: Synthetic polypeptide"

SEQ ID NO: 452 - protein, 119 aa, Artificial Sequence; identical to SEQ ID NO: 3
  source: /note="Description of Artificial Sequence: Synthetic polypeptide"

SEQ ID NO: 453 - protein, 13 aa, Artificial Sequence
  source: /note="Description of Artificial Sequence: Synthetic peptide"
ASTKGPSVFPLAP

SEQ ID NO: 454 - protein, 121 aa, Artificial Sequence [sequence omitted]

SEQ ID NO: 455 - protein, 330 aa, Artificial Sequence; identical to SEQ ID NO: 25
  source: /note="Description of Artificial Sequence: Synthetic polypeptide"

SEQ ID NO: 456 - protein, 226 aa, Artificial Sequence; identical to SEQ ID NO: 416
  source: /note="Description of Artificial Sequence: Synthetic polypeptide"

SEQ ID NO: 457 - protein, 112 aa, Artificial Sequence; identical to SEQ ID NO: 4
  source: /note="Description of Artificial Sequence: Synthetic polypeptide"

SEQ ID NO: 458 - protein, 6 aa, Artificial Sequence
  source: /note="Description of Artificial Sequence: Synthetic peptide"
QPKAAP

SEQ ID NO: 459 - protein, 108 aa, Artificial Sequence; identical to SEQ ID NO: 387
  source: /note="Description of Artificial Sequence: Synthetic polypeptide"

SEQ ID NO: 460 - protein, 106 aa, Artificial Sequence; identical to SEQ ID NO: 40
  source: /note="Description of Artificial Sequence: Synthetic polypeptide"

SEQ ID NO: 461 - protein, 250 aa, Artificial Sequence; identical to SEQ ID NO: 301
  source: /note="Description of Artificial Sequence: Synthetic polypeptide"

SEQ ID NO: 462 - protein, 121 aa, Artificial Sequence [sequence omitted]

SEQ ID NO: 463 - protein, 10 aa, Artificial Sequence
  source: /note="Description of Artificial Sequence: Synthetic peptide"
GGGGSGGGGS

SEQ ID NO: 464 - protein, 119 aa, Artificial Sequence; identical to SEQ ID NO: 3
  source: /note="Description of Artificial Sequence: Synthetic polypeptide"

SEQ ID NO: 465 - protein, 330 aa, Artificial Sequence; identical to SEQ ID NO: 25
  source: /note="Description of Artificial Sequence: Synthetic polypeptide"

SEQ ID NO: 466 - protein, 229 aa, Artificial Sequence
  source: /note="Description of Artificial Sequence: Synthetic polypeptide"
DIQMTQSPSSLSASVGDRVTITCRASRGIRNYLSWYQQKPGKAPKLLIYAASTLQSGVPSRFSGSGSGTDFTLTISSLQPEDVATYYCQRYNRAPYTFGQGTKVEIKRGGSGGGGSGQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 467 - protein, 108 aa, Artificial Sequence
  source: /note="Description of Artificial Sequence: Synthetic polypeptide"
DIQMTQSPSSLSASVGDRVTITCRASRGIRNYLSWYQQKPGKAPKLLIYAASTLQSGVPSRFSGSGSGTDFTLTISSLQPEDVATYYCQRYNRAPYTFGQGTKVEIKR

SEQ ID NO: 468 - protein, 9 aa, Artificial Sequence
  source: /note="Description of Artificial Sequence: Synthetic peptide"
GGSGGGGSG

SEQ ID NO: 469 - protein, 112 aa, Artificial Sequence; identical to SEQ ID NO: 4
  source: /note="Description of Artificial Sequence: Synthetic polypeptide"

SEQ ID NO: 470 - protein, 105 aa, Artificial Sequence; identical to SEQ ID NO: 30
  source: /note="Description of Artificial Sequence: Synthetic polypeptide"

SEQ ID NO: 471 - protein, 250 aa, Artificial Sequence; identical to SEQ ID NO: 311
  source: /note="Description of Artificial Sequence: Synthetic polypeptide"

SEQ ID NO: 472 - protein, 119 aa, Artificial Sequence; identical to SEQ ID NO: 3
  source: /note="Description of Artificial Sequence: Synthetic polypeptide"

SEQ ID NO: 473 - protein, 10 aa, Artificial Sequence
  source: /note="Description of Artificial Sequence: Synthetic peptide"
GGGGSGGGGS

SEQ ID NO: 474 - protein, 121 aa, Artificial Sequence [sequence omitted]

SEQ ID NO: 475 - protein, 330 aa, Artificial Sequence; identical to SEQ ID NO: 25
  source: /note="Description of Artificial Sequence: Synthetic polypeptide"

SEQ ID NO: 476 - protein, 229 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGGGSGGGGSGDIQMTQSPSSLSASVGDRVTITCRASRGIRNYLSWYQQKPGKAPKLLIYAASTLQSGVPSRFSGSGSGTDFTLTISSLQPEDVATYYCQRYNRAPYTFGQGTKVEIKR

SEQ ID NO: 477 - protein, 112 aa, Artificial Sequence; identical to SEQ ID NO: 4
  source: /note="Description of Artificial Sequence: Synthetic polypeptide"

SEQ ID NO: 478 - protein, 9 aa, Artificial Sequence
  source: /note="Description of Artificial Sequence: Synthetic peptide"
GGSGGGGSG

SEQ ID NO: 479 - protein, 108 aa, Artificial Sequence; identical to SEQ ID NO: 467
  source: /note="Description of Artificial Sequence: Synthetic polypeptide"

SEQ ID NO: 480 - protein, 106 aa, Artificial Sequence; identical to SEQ ID NO: 40
  source: /note="Description of Artificial Sequence: Synthetic polypeptide"

SEQ ID NO: 481 - protein, 246 aa, Artificial Sequence; identical to SEQ ID NO: 321
  source: /note="Description of Artificial Sequence: Synthetic polypeptide"

SEQ ID NO: 482 - protein, 121 aa, Artificial Sequence [sequence omitted]

SEQ ID NO: 483 - protein, 6 aa, Artificial Sequence
  source: /note="Description of Artificial Sequence: Synthetic peptide"
ASTKGP

SEQ ID NO: 484 - protein, 119 aa, Artificial Sequence; identical to SEQ ID NO: 3
  source: /note="Description of Artificial Sequence: Synthetic polypeptide"

SEQ ID NO: 485 - protein, 330 aa, Artificial Sequence; identical to SEQ ID NO: 25
  source: /note="Description of Artificial Sequence: Synthetic polypeptide"

SEQ ID NO: 486 - protein, 225 aa, Artificial Sequence
  source: /note="Description of Artificial Sequence: Synthetic polypeptide"
DIQMTQSPSSLSASVGDRVTITCRASRGIRNYLSWYQQKPGKAPKLLIYAASTLQSGVPSRFSGSGSGTDFTLTISSLQPEDVATYYCQRYNRAPYTFGQGTKVEIKRTVAAPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 487 - protein, 108 aa, Artificial Sequence; identical to SEQ ID NO: 467
  source: /note="Description of Artificial Sequence: Synthetic polypeptide"

SEQ ID NO: 488 - protein, 5 aa, Artificial Sequence
  source: /note="Description of Artificial Sequence: Synthetic peptide"
TVAAP

SEQ ID NO: 489 - protein, 112 aa, Artificial Sequence; identical to SEQ ID NO: 4
  source: /note="Description of Artificial Sequence: Synthetic polypeptide"

SEQ ID NO: 490 - protein, 105 aa, Artificial Sequence; identical to SEQ ID NO: 30
  source: /note="Description of Artificial Sequence: Synthetic polypeptide"

SEQ ID NO: 491 - protein, 246 aa, Artificial Sequence; identical to SEQ ID NO: 331
  source: /note="Description of Artificial Sequence: Synthetic polypeptide"

SEQ ID NO: 492 - protein, 119 aa, Artificial Sequence; identical to SEQ ID NO: 3
  source: /note="Description of Artificial Sequence: Synthetic polypeptide"

SEQ ID NO: 493 - protein, 6 aa, Artificial Sequence
  source: /note="Description of Artificial Sequence: Synthetic peptide"
ASTKGP

SEQ ID NO: 494 - protein, 121 aa, Artificial Sequence [sequence omitted]

SEQ ID NO: 495 - protein, 330 aa, Artificial Sequence; identical to SEQ ID NO: 25
  source: /note="Description of Artificial Sequence: Synthetic polypeptide"

SEQ ID NO: 496 - protein, 226 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPDIQMTQSPSSLSASVGDRVTITCRASRGIRNYLSWYQQKPGKAPKLLIYAASTLQSGVPSRFSGSGSGTDFTLTISSLQPEDVATYYCQRYNRAPYTFGQGTKVEIKR

SEQ ID NO: 497 - protein, 112 aa, Artificial Sequence; identical to SEQ ID NO: 4
  source: /note="Description of Artificial Sequence: Synthetic polypeptide"

SEQ ID NO: 498 - protein, 6 aa, Artificial Sequence
  source: /note="Description of Artificial Sequence: Synthetic peptide"
QPKAAP

SEQ ID NO: 499 - protein, 108 aa, Artificial Sequence; identical to SEQ ID NO: 467
  source: /note="Description of Artificial Sequence: Synthetic polypeptide"

SEQ ID NO: 500 - protein, 106 aa, Artificial Sequence; identical to SEQ ID NO: 40
  source: /note="Description of Artificial Sequence: Synthetic polypeptide"

SEQ ID NO: 501 - protein, 246 aa, Artificial Sequence; identical to SEQ ID NO: 321
  source: /note="Description of Artificial Sequence: Synthetic polypeptide"

SEQ ID NO: 502 - protein, 121 aa, Artificial Sequence [sequence omitted]

SEQ ID NO: 503 - protein, 6 aa, Artificial Sequence
  source: /note="Description of Artificial Sequence: Synthetic peptide"
ASTKGP

SEQ ID NO: 504 - protein, 119 aa, Artificial Sequence; identical to SEQ ID NO: 3
  source: /note="Description of Artificial Sequence: Synthetic polypeptide"

SEQ ID NO: 505 - protein, 330 aa, Artificial Sequence; identical to SEQ ID NO: 25
  source: /note="Description of Artificial Sequence: Synthetic polypeptide"

SEQ ID NO: 506 - protein, 232 aa, Artificial Sequence
  source: /note="Description of Artificial Sequence: Synthetic polypeptide"
DIQMTQSPSSLSASVGDRVTITCRASRGIRNYLSWYQQKPGKAPKLLIYAASTLQSGVPSRFSGSGSGTDFTLTISSLQPEDVATYYCQRYNRAPYTFGQGTKVEIKRTVAAPSVFIFPPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 507 - protein, 108 aa, Artificial Sequence; identical to SEQ ID NO: 467
  source: /note="Description of Artificial Sequence: Synthetic polypeptide"

SEQ ID NO: 508 - protein, 12 aa, Artificial Sequence
  source: /note="Description of Artificial Sequence: Synthetic peptide"
TVAAPSVFIFPP

SEQ ID NO: 509 - protein, 112 aa, Artificial Sequence; identical to SEQ ID NO: 4
  source: /note="Description of Artificial Sequence: Synthetic polypeptide"

SEQ ID NO: 510 - protein, 105 aa, Artificial Sequence; identical to SEQ ID NO: 30
  source: /note="Description of Artificial Sequence: Synthetic polypeptide"

SEQ ID NO: 511 - protein, 246 aa, Artificial Sequence; identical to SEQ ID NO: 331
  source: /note="Description of Artificial Sequence: Synthetic polypeptide"

SEQ ID NO: 512 - protein, 119 aa, Artificial Sequence; identical to SEQ ID NO: 3
  source: /note="Description of Artificial Sequence: Synthetic polypeptide"

SEQ ID NO: 513 - protein, 6 aa, Artificial Sequence
  source: /note="Description of Artificial Sequence: Synthetic peptide"
ASTKGP

SEQ ID NO: 514 - protein, 121 aa, Artificial Sequence [sequence omitted]

SEQ ID NO: 515 - protein, 330 aa, Artificial Sequence; identical to SEQ ID NO: 25
  source: /note="Description of Artificial Sequence: Synthetic polypeptide"

SEQ ID NO: 516 - protein, 233 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPSVTLFPPDIQMTQSPSSLSASVGDRVTITCRASRGIRNYLSWYQQKPGKAPKLLIYAASTLQSGVPSRFSGSGSGTDFTLTISSLQPEDVATYYCQRYNRAPYTFGQGTKVEIKR

SEQ ID NO: 517 - protein, 112 aa, Artificial Sequence; identical to SEQ ID NO: 4
  source: /note="Description of Artificial Sequence: Synthetic polypeptide"

SEQ ID NO: 518 - protein, 13 aa, Artificial Sequence
  source: /note="Description of Artificial Sequence: Synthetic peptide"
QPKAAPSVTLFPP

SEQ ID NO: 519 - protein, 108 aa, Artificial Sequence; identical to SEQ ID NO: 467
  source: /note="Description of Artificial Sequence: Synthetic polypeptide"

SEQ ID NO: 520 - protein, 106 aa, Artificial Sequence; identical to SEQ ID NO: 40
  source: /note="Description of Artificial Sequence: Synthetic polypeptide"

SEQ ID NO: 521 - protein, 253 aa, Artificial Sequence; identical to SEQ ID NO: 361
  source: /note="Description of Artificial Sequence: Synthetic polypeptide"

SEQ ID NO: 522 - protein, 121 aa, Artificial Sequence [sequence omitted]

SEQ ID NO: 523 - protein, 13 aa, Artificial Sequence
  source: /note="Description of Artificial Sequence: Synthetic peptide"
ASTKGPSVFPLAP

SEQ ID NO: 524 - protein, 119 aa, Artificial Sequence; identical to SEQ ID NO: 3
  source: /note="Description of Artificial Sequence: Synthetic polypeptide"

SEQ ID NO: 525 - protein, 330 aa, Artificial Sequence; identical to SEQ ID NO: 25
  source: /note="Description of Artificial Sequence: Synthetic polypeptide"

SEQ ID NO: 526 - protein, 225 aa, Artificial Sequence; identical to SEQ ID NO: 486
  source: /note="Description of Artificial Sequence: Synthetic polypeptide"

SEQ ID NO: 527 - protein, 108 aa, Artificial Sequence; identical to SEQ ID NO: 467
  source: /note="Description of Artificial Sequence: Synthetic polypeptide"

SEQ ID NO: 528 - protein, 5 aa, Artificial Sequence
  source: /note="Description of Artificial Sequence: Synthetic peptide"
TVAAP

SEQ ID NO: 529 - protein, 112 aa, Artificial Sequence; identical to SEQ ID NO: 4
  source: /note="Description of Artificial Sequence: Synthetic polypeptide"

SEQ ID NO: 530 - protein, 105 aa, Artificial Sequence; identical to SEQ ID NO: 30
  source: /note="Description of Artificial Sequence: Synthetic polypeptide"

SEQ ID NO: 531 - protein, 253 aa, Artificial Sequence; identical to SEQ ID NO: 371
  source: /note="Description of Artificial Sequence: Synthetic polypeptide"

SEQ ID NO: 532 - protein, 119 aa, Artificial Sequence; identical to SEQ ID NO: 3
  source: /note="Description of Artificial Sequence: Synthetic polypeptide"

SEQ ID NO: 533 - protein, 13 aa, Artificial Sequence
  source: /note="Description of Artificial Sequence: Synthetic peptide"
ASTKGPSVFPLAP

SEQ ID NO: 534 - protein, 121 aa, Artificial Sequence [sequence omitted]

SEQ ID NO: 535 - protein, 330 aa, Artificial Sequence; identical to SEQ ID NO: 25
  source: /note="Description of Artificial Sequence: Synthetic polypeptide"

SEQ ID NO: 536 - protein, 226 aa, Artificial Sequence; identical to SEQ ID NO: 496
  source: /note="Description of Artificial Sequence: Synthetic polypeptide"

SEQ ID NO: 537 - protein, 112 aa, Artificial Sequence; identical to SEQ ID NO: 4
  source: /note="Description of Artificial Sequence: Synthetic polypeptide"

SEQ ID NO: 538 - protein, 6 aa, Artificial Sequence
  source: /note="Description of Artificial Sequence: Synthetic peptide"
QPKAAP

SEQ ID NO: 539 - protein, 108 aa, Artificial Sequence; identical to SEQ ID NO: 467
  source: /note="Description of Artificial Sequence: Synthetic polypeptide"

SEQ ID NO: 540 - protein, 106 aa, Artificial Sequence; identical to SEQ ID NO: 40
  source: /note="Description of Artificial Sequence: Synthetic polypeptide"

SEQ ID NO: 541 - protein, 250 aa, Artificial Sequence; identical to SEQ ID NO: 301
  source: /note="Description of Artificial Sequence: Synthetic polypeptide"

SEQ ID NO: 542 - protein, 121 aa, Artificial Sequence [sequence omitted]

SEQ ID NO: 543 - protein, 10 aa, Artificial Sequence
  source: /note="Description of Artificial Sequence: Synthetic peptide"
GGGGSGGGGS

SEQ ID NO: 544 - protein, 119 aa, Artificial Sequence; identical to SEQ ID NO: 3
  source: /note="Description of Artificial Sequence: Synthetic polypeptide"

SEQ ID NO: 545 - protein, 330 aa, Artificial Sequence; identical to SEQ ID NO: 25
  source: /note="Description of Artificial Sequence: Synthetic polypeptide"

SEQ ID NO: 546 - protein, 229 aa, Artificial Sequence
  source: /note="Description of Artificial Sequence: Synthetic polypeptide"
DIQMTQSPSSLSASVGDRVTITCRASHGIRNYLSWYQQKPGKAPKLLIYAASTLQSGVPSRFSGSGSGTDFTLTISSLQPEDVATYYCQRYNRAPYTFGQGTKVEIKRGGSGGGGSGQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 547 - protein, 108 aa, Artificial Sequence
  source: /note="Description of Artificial Sequence: Synthetic polypeptide"
DIQMTQSPSSLSASVGDRVTITCRASHGIRNYLSWYQQKPGKAPKLLIYAASTLQSGVPSRFSGSGSGTDFTLTISSLQPEDVATYYCQRYNRAPYTFGQGTKVEIKR

SEQ ID NO: 548 - protein, 9 aa, Artificial Sequence
  source: /note="Description of Artificial Sequence: Synthetic peptide"
GGSGGGGSG

SEQ ID NO: 549 - protein, 112 aa, Artificial Sequence; identical to SEQ ID NO: 4
  source: /note="Description of Artificial Sequence: Synthetic polypeptide"

SEQ ID NO: 550 - protein, 105 aa, Artificial Sequence; identical to SEQ ID NO: 30
  source: /note="Description of Artificial Sequence: Synthetic polypeptide"

SEQ ID NO: 551 - protein, 250 aa, Artificial Sequence; identical to SEQ ID NO: 311
  source: /note="Description of Artificial Sequence: Synthetic polypeptide"

SEQ ID NO: 552 - protein, 119 aa, Artificial Sequence; identical to SEQ ID NO: 3
  source: /note="Description of Artificial Sequence: Synthetic polypeptide"

SEQ ID NO: 553 - protein, 10 aa, Artificial Sequence
  source: /note="Description of Artificial Sequence: Synthetic peptide"
GGGGSGGGGS

SEQ ID NO: 554 - protein, 121 aa, Artificial Sequence [sequence omitted]

SEQ ID NO: 555 - protein, 330 aa, Artificial Sequence; identical to SEQ ID NO: 25
  source: /note="Description of Artificial Sequence: Synthetic polypeptide"

SEQ ID NO: 556 - protein, 229 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGGGSGGGGSGDIQMTQSPSSLSASVGDRVTITCRASHGIRNYLSWYQQKPGKAPKLLIYAASTLQSGVPSRFSGSGSGTDFTLTISSLQPEDVATYYCQRYNRAPYTFGQGTKVEIKR

SEQ ID NO: 557 - protein, 112 aa, Artificial Sequence; identical to SEQ ID NO: 4
  source: /note="Description of Artificial Sequence: Synthetic polypeptide"

SEQ ID NO: 558 - protein, 9 aa, Artificial Sequence
  source: /note="Description of Artificial Sequence: Synthetic peptide"
GGSGGGGSG

SEQ ID NO: 559 - protein, 108 aa, Artificial Sequence; identical to SEQ ID NO: 547
  source: /note="Description of Artificial Sequence: Synthetic polypeptide"

SEQ ID NO: 560 - protein, 106 aa, Artificial Sequence; identical to SEQ ID NO: 40
  source: /note="Description of Artificial Sequence: Synthetic polypeptide"

SEQ ID NO: 561 - protein, 246 aa, Artificial Sequence; identical to SEQ ID NO: 321
  source: /note="Description of Artificial Sequence: Synthetic polypeptide"

SEQ ID NO: 562 - protein, 121 aa, Artificial Sequence [sequence omitted]

SEQ ID NO: 563 - protein, 6 aa, Artificial Sequence
  source: /note="Description of Artificial Sequence: Synthetic peptide"
ASTKGP

SEQ ID NO: 564 - protein, 119 aa, Artificial Sequence; identical to SEQ ID NO: 3
  source: /note="Description of Artificial Sequence: Synthetic polypeptide"

SEQ ID NO: 565 - protein, 330 aa, Artificial Sequence; identical to SEQ ID NO: 25
  source: /note="Description of Artificial Sequence: Synthetic polypeptide"

SEQ ID NO: 566 - protein, 225 aa, Artificial Sequence
  source: /note="Description of Artificial Sequence: Synthetic polypeptide"
DIQMTQSPSSLSASVGDRVTITCRASHGIRNYLSWYQQKPGKAPKLLIYAASTLQSGVPSRFSGSGSGTDFTLTISSLQPEDVATYYCQRYNRAPYTFGQGTKVEIKRTVAAPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 567 - protein, 108 aa, Artificial Sequence; identical to SEQ ID NO: 547
  source: /note="Description of Artificial Sequence: Synthetic polypeptide"

SEQ ID NO: 568 - protein, 5 aa, Artificial Sequence
  source: /note="Description of Artificial Sequence: Synthetic peptide"
TVAAP

SEQ ID NO: 569 - protein, 112 aa, Artificial Sequence; identical to SEQ ID NO: 4
  source: /note="Description of Artificial Sequence: Synthetic polypeptide"

SEQ ID NO: 570 - protein, 105 aa, Artificial Sequence; identical to SEQ ID NO: 30
  source: /note="Description of Artificial Sequence: Synthetic polypeptide"

SEQ ID NO: 571 - protein, 246 aa, Artificial Sequence; identical to SEQ ID NO: 331
  source: /note="Description of Artificial Sequence: Synthetic polypeptide"

SEQ ID NO: 572 - protein, 119 aa, Artificial Sequence; identical to SEQ ID NO: 3
  source: /note="Description of Artificial Sequence: Synthetic polypeptide"

SEQ ID NO: 573 - protein, 6 aa, Artificial Sequence
  source: /note="Description of Artificial Sequence: Synthetic peptide"
ASTKGP

SEQ ID NO: 574 - protein, 121 aa, Artificial Sequence [sequence omitted]

SEQ ID NO: 575 - protein, 330 aa, Artificial Sequence; identical to SEQ ID NO: 25
  source: /note="Description of Artificial Sequence: Synthetic polypeptide"

SEQ ID NO: 576 - protein, 226 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPDIQMTQSPSSLSASVGDRVTITCRASHGIRNYLSWYQQKPGKAPKLLIYAASTLQSGVPSRFSGSGSGTDFTLTISSLQPEDVATYYCQRYNRAPYTFGQGTKVEIKR

SEQ ID NO: 577 - protein, 112 aa, Artificial Sequence; identical to SEQ ID NO: 4
  source: /note="Description of Artificial Sequence: Synthetic polypeptide"

SEQ ID NO: 578 - protein, 6 aa, Artificial Sequence
  source: /note="Description of Artificial Sequence: Synthetic peptide"
QPKAAP

SEQ ID NO: 579 - protein, 108 aa, Artificial Sequence; identical to SEQ ID NO: 547
  source: /note="Description of Artificial Sequence: Synthetic polypeptide"

SEQ ID NO: 580 - protein, 106 aa, Artificial Sequence; identical to SEQ ID NO: 40
  source: /note="Description of Artificial Sequence: Synthetic polypeptide"

SEQ ID NO: 581 - protein, 246 aa, Artificial Sequence; identical to SEQ ID NO: 321
  source: /note="Description of Artificial Sequence: Synthetic polypeptide"

SEQ ID NO: 582 - protein, 121 aa, Artificial Sequence [sequence omitted]

SEQ ID NO: 583 - protein, 6 aa, Artificial Sequence
  source: /note="Description of Artificial Sequence: Synthetic peptide"
ASTKGP

SEQ ID NO: 584 - protein, 119 aa, Artificial Sequence; identical to SEQ ID NO: 3
  source: /note="Description of Artificial Sequence: Synthetic polypeptide"

SEQ ID NO: 585 - protein, 330 aa, Artificial Sequence; identical to SEQ ID NO: 25
  source: /note="Description of Artificial Sequence: Synthetic polypeptide"

SEQ ID NO: 586 - protein, 232 aa, Artificial Sequence
  source: /note="Description of Artificial Sequence: Synthetic polypeptide"
DIQMTQSPSSLSASVGDRVTITCRASHGIRNYLSWYQQKPGKAPKLLIYAASTLQSGVPSRFSGSGSGTDFTLTISSLQPEDVATYYCQRYNRAPYTFGQGTKVEIKRTVAAPSVFIFPPQSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLG

SEQ ID NO: 587 - protein, 108 aa, Artificial Sequence; identical to SEQ ID NO: 547
  source: /note="Description of Artificial Sequence: Synthetic polypeptide"

SEQ ID NO: 588 - protein, 12 aa, Artificial Sequence
  source: /note="Description of Artificial Sequence: Synthetic peptide"
TVAAPSVFIFPP

SEQ ID NO: 589 - protein, 112 aa, Artificial Sequence; identical to SEQ ID NO: 4
  source: /note="Description of Artificial Sequence: Synthetic polypeptide"

SEQ ID NO: 590 - protein, 105 aa, Artificial Sequence; identical to SEQ ID NO: 30
  source: /note="Description of Artificial Sequence: Synthetic polypeptide"

SEQ ID NO: 591 - protein, 246 aa, Artificial Sequence; identical to SEQ ID NO: 331
  source: /note="Description of Artificial Sequence: Synthetic polypeptide"

SEQ ID NO: 592 - protein, 119 aa, Artificial Sequence; identical to SEQ ID NO: 3
  source: /note="Description of Artificial Sequence: Synthetic polypeptide"

SEQ ID NO: 593 - protein, 6 aa, Artificial Sequence
  source: /note="Description of Artificial Sequence: Synthetic peptide"
ASTKGP

SEQ ID NO: 594 - protein, 121 aa, Artificial Sequence [sequence omitted]

SEQ ID NO: 595 - protein, 330 aa, Artificial Sequence; identical to SEQ ID NO: 25
  source: /note="Description of Artificial Sequence: Synthetic polypeptide"

SEQ ID NO: 596 - protein, 233 aa, Artificial Sequence
  source: /note="Description of Artificial Sequence: Synthetic polypeptide"
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGQPKAAPSVTLFPPDIQMTQSPSSLSASVGDRVTITCRASHGIRNYLSWYQQKPGKAPKLLIYAASTLQSGVPSRFSGSGSGTDFTLTISSLQPEDVATYYCQRYNRAPYTFGQGTKVEIKR

SEQ ID NO: 597 - protein, 112 aa, Artificial Sequence; identical to SEQ ID NO: 4
  source: /note="Description of Artificial Sequence: Synthetic polypeptide"

SEQ ID NO: 598 - protein, 13 aa, Artificial Sequence
  source: /note="Description of Artificial Sequence: Synthetic peptide"
QPKAAPSVTLFPP

SEQ ID NO: 599 - protein, 108 aa, Artificial Sequence; identical to SEQ ID NO: 547
  source: /note="Description of Artificial Sequence: Synthetic polypeptide"

SEQ ID NO: 600 - protein, 106 aa, Artificial Sequence; identical to SEQ ID NO: 40
  source: /note="Description of Artificial Sequence: Synthetic polypeptide"

SEQ ID NO: 601 - protein, 253 aa, Artificial Sequence; identical to SEQ ID NO: 361
  source: /note="Description of Artificial Sequence: Synthetic polypeptide"

SEQ ID NO: 602 - protein, 121 aa, Artificial Sequence [sequence omitted]

SEQ ID NO: 603 - protein, 13 aa, Artificial Sequence
  source: /note="Description of Artificial Sequence: Synthetic peptide"
ASTKGPSVFPLAP

SEQ ID NO: 604 - protein, 119 aa, Artificial Sequence; identical to SEQ ID NO: 3
  source: /note="Description of Artificial Sequence: Synthetic polypeptide"

SEQ ID NO: 605 - protein, 330 aa, Artificial Sequence; identical to SEQ ID NO: 25
  source: /note="Description of Artificial Sequence: Synthetic polypeptide"

SEQ ID NO: 606 - protein, 225 aa, Artificial Sequence; identical to SEQ ID NO: 566
  source: /note="Description of Artificial Sequence: Synthetic polypeptide"

SEQ ID NO: 607 - protein, 108 aa, Artificial Sequence; identical to SEQ ID NO: 547
  source: /note="Description of Artificial Sequence: Synthetic polypeptide"

SEQ ID NO: 608 - protein, 5 aa, Artificial Sequence
  source: /note="Description of Artificial Sequence: Synthetic peptide"
TVAAP

SEQ ID NO: 609 - protein, 112 aa, Artificial Sequence; identical to SEQ ID NO: 4
  source: /note="Description of Artificial Sequence: Synthetic polypeptide"

SEQ ID NO: 610 - protein, 105 aa, Artificial Sequence; identical to SEQ ID NO: 30
  source: /note="Description of Artificial Sequence: Synthetic polypeptide"

SEQ ID NO: 611 - protein, 253 aa, Artificial Sequence; identical to SEQ ID NO: 371
  source: /note="Description of Artificial Sequence: Synthetic polypeptide"

SEQ ID NO: 612 - protein, 119 aa, Artificial Sequence; identical to SEQ ID NO: 3
  source: /note="Description of Artificial Sequence: Synthetic polypeptide"

SEQ ID NO: 613 - protein, 13 aa, Artificial Sequence
  source: /note="Description of Artificial Sequence: Synthetic peptide"
ASTKGPSVFPLAP

SEQ ID NO: 614 - protein, 121 aa, Artificial Sequence [sequence omitted]

SEQ ID NO: 615 - protein, 330 aa, Artificial Sequence; identical to SEQ ID NO: 25
  source: /note="Description of Artificial Sequence: Synthetic polypeptide"

SEQ ID NO: 616 - protein, 226 aa, Artificial Sequence; identical to SEQ ID NO: 576
  source: /note="Description of Artificial Sequence: Synthetic polypeptide"

SEQ ID NO: 617 - protein, 112 aa, Artificial Sequence; identical to SEQ ID NO: 4
  source: /note="Description of Artificial Sequence: Synthetic polypeptide"

SEQ ID NO: 618 - protein, 6 aa, Artificial Sequence
  source: /note="Description of Artificial Sequence: Synthetic peptide"
QPKAAP

SEQ ID NO: 619 - protein, 108 aa, Artificial Sequence; identical to SEQ ID NO: 547
  source: /note="Description of Artificial Sequence: Synthetic polypeptide"

SEQ ID NO: 620 - protein, 106 aa, Artificial Sequence; identical to SEQ ID NO: 40
  source: /note="Description of Artificial Sequence: Synthetic polypeptide"

SEQ ID NO: 621 - protein, 254 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSS

SEQ ID NO: 622 - protein, 121 aa, Artificial Sequence [sequence omitted]

SEQ ID NO: 623 - protein, 10 aa, Artificial Sequence
  source: /note="Description of Artificial Sequence: Synthetic peptide"
GGGGSGGGGS

SEQ ID NO: 624 - protein, 123 aa, Artificial Sequence [sequence omitted]

SEQ ID NO: 625 - protein, 330 aa, Artificial Sequence; identical to SEQ ID NO: 25
  source: /note="Description of Artificial Sequence: Synthetic polypeptide"

SEQ ID NO: 626 - protein, 225 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGDIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKR

SEQ ID NO: 627 - protein, 108 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR

SEQ ID NO: 628 - protein, 9 aa, Artificial Sequence
  source: /note="Description of Artificial Sequence: Synthetic peptide"
GGSGGGGSG

SEQ ID NO: 629 - protein, 108 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKR

SEQ ID NO: 630 - protein, 106 aa, Artificial Sequence; identical to SEQ ID NO: 40
  source: /note="Description of Artificial Sequence: Synthetic polypeptide"

SEQ ID NO: 631 - protein, 250 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSS

SEQ ID NO: 632 - protein, 121 aa, Artificial Sequence [sequence omitted]

SEQ ID NO: 633 - protein, 6 aa, Artificial Sequence
  source: /note="Description of Artificial Sequence: Synthetic peptide"
ASTKGP

SEQ ID NO: 634 - protein, 123 aa, Artificial Sequence [sequence omitted]

SEQ ID NO: 635 - protein, 330 aa, Artificial Sequence; identical to SEQ ID NO: 25
  source: /note="Description of Artificial Sequence: Synthetic polypeptide"

SEQ ID NO: 636 - protein, 221 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPDIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKR

SEQ ID NO: 637 - protein, 108 aa, Artificial Sequence; identical to SEQ ID NO: 627
  source: /note="Description of Artificial Sequence: Synthetic polypeptide"

SEQ ID NO: 638 - protein, 5 aa, Artificial Sequence
  source: /note="Description of Artificial Sequence: Synthetic peptide"
TVAAP

SEQ ID NO: 639 - protein, 108 aa, Artificial Sequence; identical to SEQ ID NO: 629
  source: /note="Description of Artificial Sequence: Synthetic polypeptide"

SEQ ID NO: 640 - protein, 106 aa, Artificial Sequence; identical to SEQ ID NO: 40
  source: /note="Description of Artificial Sequence: Synthetic polypeptide"

SEQ ID NO: 641 - protein, 255 aa, Artificial Sequence
  source: /note="Description of Artificial Sequence: Synthetic polypeptide"
EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSSGGGGSGGGGSEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSS

SEQ ID NO: 642 - protein, 124 aa, Artificial Sequence
  source: /note="Description of Artificial Sequence: Synthetic polypeptide"
EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSS

SEQ ID NO: 643 - protein, 10 aa, Artificial Sequence
  source: /note="Description of Artificial Sequence: Synthetic peptide"
GGGGSGGGGS

SEQ ID NO: 644 - protein, 121 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSS

SEQ ID NO: 645 - protein, 330 aa, Artificial Sequence; identical to SEQ ID NO: 25
  source: /note="Description of Artificial Sequence: Synthetic polypeptide"

SEQ ID NO: 646 - protein, 227 aa, Artificial Sequence
  source: /note="Description of Artificial Sequence: Synthetic polypeptide"
DIQMTQSPSSLSASVGDRVTITCRASQDISQYLNWYQQKPGKAPKLLIYYTSRLQSGVPSRFSGSGSGTDFTLTISSLQPEDFATYFCQQGNTWPPTFGQGTKLEIKRGGSGGGGSGQAVVTQEPSLTVSPGGTVTLTCGSSTGTVTIDHYPYWFQQKPGQAPRTLISDTDDKHSWTPARFSGSLLGGKAALTLSGAQPEDEAEYYCLLDYGGRFVFGGGTKLTVLG

SEQ ID NO: 647 - protein, 108 aa, Artificial Sequence
  source: /note="Description of Artificial Sequence: Synthetic polypeptide"
DIQMTQSPSSLSASVGDRVTITCRASQDISQYLNWYQQKPGKAPKLLIYYTSRLQSGVPSRFSGSGSGTDFTLTISSLQPEDFATYFCQQGNTWPPTFGQGTKLEIKR

SEQ ID NO: 648 - protein, 9 aa, Artificial Sequence
  source: /note="Description of Artificial Sequence: Synthetic peptide"
GGSGGGGSG

SEQ ID NO: 649 - protein, 110 aa, Artificial Sequence
  source: /note="Description of Artificial Sequence: Synthetic polypeptide"
QAVVTQEPSLTVSPGGTVTLTCGSSTGTVTIDHYPYWFQQKPGQAPRTLISDTDDKHSWTPARFSGSLLGGKAALTLSGAQPEDEAEYYCLLDYGGRFVFGGGTKLTVLG

SEQ ID NO: 650 - protein, 105 aa, Artificial Sequence; identical to SEQ ID NO: 30
  source: /note="Description of Artificial Sequence: Synthetic polypeptide"

SEQ ID NO: 651 - protein, 251 aa, Artificial Sequence
  source: /note="Description of Artificial Sequence: Synthetic polypeptide"
EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSSASTKGPEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSS

SEQ ID NO: 652 - protein, 124 aa, Artificial Sequence; identical to SEQ ID NO: 642
  source: /note="Description of Artificial Sequence: Synthetic polypeptide"

SEQ ID NO: 653 - protein, 6 aa, Artificial Sequence
  source: /note="Description of Artificial Sequence: Synthetic peptide"
ASTKGP

SEQ ID NO: 654 - protein, 121 aa, Artificial Sequence; identical to SEQ ID NO: 644
  source: /note="Description of Artificial Sequence: Synthetic polypeptide"

SEQ ID NO: 655 - protein, 330 aa, Artificial Sequence; identical to SEQ ID NO: 25
  source: /note="Description of Artificial Sequence: Synthetic polypeptide"

SEQ ID NO: 656 - protein, 223 aa, Artificial Sequence
  source: /note="Description of Artificial Sequence: Synthetic polypeptide"
DIQMTQSPSSLSASVGDRVTITCRASQDISQYLNWYQQKPGKAPKLLIYYTSRLQSGVPSRFSGSGSGTDFTLTISSLQPEDFATYFCQQGNTWPPTFGQGTKLEIKRTVAAPQAVVTQEPSLTVSPGGTVTLTCGSSTGTVTIDHYPYWFQQKPGQAPRTLISDTDDKHSWTPARFSGSLLGGKAALTLSGAQPEDEAEYYCLLDYGGRFVFGGGTKLTVLG

SEQ ID NO: 657 - protein, 108 aa, Artificial Sequence; identical to SEQ ID NO: 647
  source: /note="Description of Artificial Sequence: Synthetic polypeptide"

SEQ ID NO: 658 - protein, 5 aa, Artificial Sequence
  source: /note="Description of Artificial Sequence: Synthetic peptide"
TVAAP

SEQ ID NO: 659 - protein, 110 aa, Artificial Sequence; identical to SEQ ID NO: 649
  source: /note="Description of Artificial Sequence: Synthetic polypeptide"

SEQ ID NO: 660 - protein, 105 aa, Artificial Sequence; identical to SEQ ID NO: 30
  source: /note="Description of Artificial Sequence: Synthetic polypeptide"

SEQ ID NO: 661 - protein, 248 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSS

SEQ ID NO: 662 - protein, 117 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS

SEQ ID NO: 663 - protein, 10 aa, Artificial Sequence
  source: /note="Description of Artificial Sequence: Synthetic peptide"
GGGGSGGGGS

SEQ ID NO: 664 - protein, 121 aa, Artificial Sequence; identical to SEQ ID NO: 644
  source: /note="Description of Artificial Sequence: Synthetic polypeptide"

SEQ ID NO: 665 - protein, 330 aa, Artificial Sequence; identical to SEQ ID NO: 25
  source: /note="Description of Artificial Sequence: Synthetic polypeptide"

SEQ ID NO: 666 - protein, 226 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKGGSGGGGSGQAVVTQEPSLTVSPGGTVTLTCGSSTGTVTIDHYPYWFQQKPGQAPRTLISDTDDKHSWTPARFSGSLLGGKAALTLSGAQPEDEAEYYCLLDYGGRFVFGGGTKLTVLG

SEQ ID NO: 667 - protein, 107 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIK

SEQ ID NO: 668 - protein, 9 aa, Artificial Sequence
  source: /note="Description of Artificial Sequence: Synthetic peptide"
GGSGGGGSG

SEQ ID NO: 669 - protein, 110 aa, Artificial Sequence; identical to SEQ ID NO: 649
  source: /note="Description of Artificial Sequence: Synthetic polypeptide"

SEQ ID NO: 670 - protein, 105 aa, Artificial Sequence; identical to SEQ ID NO: 30
  source: /note="Description of Artificial Sequence: Synthetic polypeptide"

SEQ ID NO: 671 - protein, 244 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSASTKGPEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSS

SEQ ID NO: 672 - protein, 117 aa, Artificial Sequence; identical to SEQ ID NO: 662
  source: /note="Description of Artificial Sequence: Synthetic polypeptide"

SEQ ID NO: 673 - protein, 6 aa, Artificial Sequence
  source: /note="Description of Artificial Sequence: Synthetic peptide"
ASTKGP

SEQ ID NO: 674 - protein, 121 aa, Artificial Sequence; identical to SEQ ID NO: 644
  source: /note="Description of Artificial Sequence: Synthetic polypeptide"

SEQ ID NO: 675 - protein, 330 aa, Artificial Sequence; identical to SEQ ID NO: 25
  source: /note="Description of Artificial Sequence: Synthetic polypeptide"

SEQ ID NO: 676 - protein, 223 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPQAVVTQEPSLTVSPGGTVTLTCGSSTGTVTIDHYPYWFQQKPGQAPRTLISDTDDKHSWTPARFSGSLLGGKAALTLSGAQPEDEAEYYCLLDYGGRFVFGGGTKLTVLG

SEQ ID NO: 677 - protein, 108 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR

SEQ ID NO: 678 - protein, 5 aa, Artificial Sequence
  source: /note="Description of Artificial Sequence: Synthetic peptide"
TVAAP

SEQ ID NO: 679 - protein, 110 aa, Artificial Sequence; identical to SEQ ID NO: 649
  source: /note="Description of Artificial Sequence: Synthetic polypeptide"

SEQ ID NO: 680 - protein, 105 aa, Artificial Sequence; identical to SEQ ID NO: 30
  source: /note="Description of Artificial Sequence: Synthetic polypeptide"

SEQ ID NO: 681 - protein, 255 aa, Artificial Sequence; identical to SEQ ID NO: 641
  source: /note="Description of Artificial Sequence: Synthetic polypeptide"

SEQ ID NO: 682 - protein, 124 aa, Artificial Sequence; identical to SEQ ID NO: 642
  source: /note="Description of Artificial Sequence: Synthetic polypeptide"

SEQ ID NO: 683 - protein, 10 aa, Artificial Sequence
  source: /note="Description of Artificial Sequence: Synthetic peptide"
GGGGSGGGGS

SEQ ID NO: 684 - protein, 121 aa, Artificial Sequence; identical to SEQ ID NO: 644
  source: /note="Description of Artificial Sequence: Synthetic polypeptide"

SEQ ID NO: 685 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDQLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 686 - protein, 227 aa, Artificial Sequence; identical to SEQ ID NO: 646
  source: /note="Description of Artificial Sequence: Synthetic polypeptide"

SEQ ID NO: 687 - protein, 108 aa, Artificial Sequence; identical to SEQ ID NO: 647
  source: /note="Description of Artificial Sequence: Synthetic polypeptide"

SEQ ID NO: 688 - protein, 9 aa, Artificial Sequence
  source: /note="Description of Artificial Sequence: Synthetic peptide"
GGSGGGGSG

SEQ ID NO: 689 - protein, 110 aa, Artificial Sequence; identical to SEQ ID NO: 649
  source: /note="Description of Artificial Sequence: Synthetic polypeptide"

SEQ ID NO: 690 - protein, 105 aa, Artificial Sequence; identical to SEQ ID NO: 30
  source: /note="Description of Artificial Sequence: Synthetic polypeptide"

SEQ ID NO: 691 - protein, 251 aa, Artificial Sequence; identical to SEQ ID NO: 651
  source: /note="Description of Artificial Sequence: Synthetic polypeptide"

SEQ ID NO: 692 - protein, 124 aa, Artificial Sequence; identical to SEQ ID NO: 642
  source: /note="Description of Artificial Sequence: Synthetic polypeptide"

SEQ ID NO: 693 - protein, 6 aa, Artificial Sequence
  source: /note="Description of Artificial Sequence: Synthetic peptide"
ASTKGP

SEQ ID NO: 694 - protein, 121 aa, Artificial Sequence; identical to SEQ ID NO: 644
  source: /note="Description of Artificial Sequence: Synthetic polypeptide"

SEQ ID NO: 695 - protein, 330 aa, Artificial Sequence; identical to SEQ ID NO: 685
  source: /note="Description of Artificial Sequence: Synthetic polypeptide"

SEQ ID NO: 696 - protein, 223 aa, Artificial Sequence; identical to SEQ ID NO: 656
  source: /note="Description of Artificial Sequence: Synthetic polypeptide"

SEQ ID NO: 697 - protein, 108 aa, Artificial Sequence; identical to SEQ ID NO: 647
  source: /note="Description of Artificial Sequence: Synthetic polypeptide"

SEQ ID NO: 698 - protein, 5 aa, Artificial Sequence
  source: /note="Description of Artificial Sequence: Synthetic peptide"
TVAAP

SEQ ID NO: 699 - protein, 110 aa, Artificial Sequence; identical to SEQ ID NO: 649
  source: /note="Description of Artificial Sequence: Synthetic polypeptide"

SEQ ID NO: 700 - protein, 105 aa, Artificial Sequence; identical to SEQ ID NO: 30
  source: /note="Description of Artificial Sequence: Synthetic polypeptide"

SEQ ID NO: 701 - protein, 248 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSAGYWYKFFQHWGQGTLVTVSS

SEQ ID NO: 702 - protein, 117 aa, Artificial Sequence; identical to SEQ ID NO: 662
  source: /note="Description of Artificial Sequence: Synthetic polypeptide"

SEQ ID NO: 703 - protein, 10 aa, Artificial Sequence
  source: /note="Description of Artificial Sequence: Synthetic peptide"
GGGGSGGGGS

SEQ ID NO: 704 - protein, 121 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSAGYWYKFFQHWGQGTLVTVSS

SEQ ID NO: 705 - protein, 330 aa, Artificial Sequence; identical to SEQ ID NO: 25
  source: /note="Description of Artificial Sequence: Synthetic polypeptide"

SEQ ID NO: 706 - protein, 226 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKGGSGGGGSGQAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGTFVFGGGTKLTVLG

SEQ ID NO: 707 - protein, 107 aa, Artificial Sequence; identical to SEQ ID NO: 667
  source: /note="Description of Artificial Sequence: Synthetic polypeptide"

SEQ ID NO: 708 - protein, 9 aa, Artificial Sequence
  source: /note="Description of Artificial Sequence: Synthetic peptide"
GGSGGGGSG

SEQ ID NO: 709 - protein, 110 aa, Artificial Sequence
  source: /note="Description of Artificial Sequence: Synthetic polypeptide"
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGTFVFGGGTKLTVLG

SEQ ID NO: 710 - protein, 105 aa, Artificial Sequence; identical to SEQ ID NO: 30
  source: /note="Description of Artificial Sequence: Synthetic polypeptide"

SEQ ID NO: 711 - protein, 248 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSSGGGGSGGGGSEVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS

SEQ ID NO: 712 - protein, 121 aa, Artificial Sequence; identical to SEQ ID NO: 644
  source: /note="Description of Artificial Sequence: Synthetic polypeptide"

SEQ ID NO: 713 - protein, 10 aa, Artificial Sequence
  source: /note="Description of Artificial Sequence: Synthetic peptide"
GGGGSGGGGS

SEQ ID NO: 714 - protein, 117 aa, Artificial Sequence; identical to SEQ ID NO: 662
  source: /note="Description of Artificial Sequence: Synthetic polypeptide"

SEQ ID NO: 715 - protein, 330 aa, Artificial Sequence; identical to SEQ ID NO: 25
  source: /note="Description of Artificial Sequence: Synthetic polypeptide"

SEQ ID NO: 716 - protein, 227 aa, Artificial Sequence
  source: /note="Description of Artificial Sequence: Synthetic polypeptide"
QAVVTQEPSLTVSPGGTVTLTCGSSTGTVTIDHYPYWFQQKPGQAPRTLISDTDDKHSWTPARFSGSLLGGKAALTLSGAQPEDEAEYYCLLDYGGRFVFGGGTKLTVLGGGSGGGGSGDIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR

SEQ ID NO: 717 - protein, 110 aa, Artificial Sequence; identical to SEQ ID NO: 649
  source: /note="Description of Artificial Sequence: Synthetic polypeptide"

SEQ ID NO: 718 - protein, 9 aa, Artificial Sequence
  source: /note="Description of Artificial Sequence: Synthetic peptide"
GGSGGGGSG

SEQ ID NO: 719 - protein, 108 aa, Artificial Sequence; identical to SEQ ID NO: 677
  source: /note="Description of Artificial Sequence: Synthetic polypeptide"

SEQ ID NO: 720 - protein, 106 aa, Artificial Sequence; identical to SEQ ID NO: 40
  source: /note="Description of Artificial Sequence: Synthetic polypeptide"

SEQ ID NO: 721 - protein, 255 aa, Artificial Sequence; identical to SEQ ID NO: 641
  source: /note="Description of Artificial Sequence: Synthetic polypeptide"

SEQ ID NO: 722 - protein, 124 aa, Artificial Sequence; identical to SEQ ID NO: 642
  source: /note="Description of Artificial Sequence: Synthetic polypeptide"

SEQ ID NO: 723 - protein, 10 aa, Artificial Sequence
  source: /note="Description of Artificial Sequence: Synthetic peptide"
GGGGSGGGGS

SEQ ID NO: 724 - protein, 121 aa, Artificial Sequence; identical to SEQ ID NO: 644
  source: /note="Description of Artificial Sequence: Synthetic polypeptide"

SEQ ID NO: 725 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDQLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 726 - protein, 227 aa, Artificial Sequence; identical to SEQ ID NO: 646
  source: /note="Description of Artificial Sequence: Synthetic polypeptide"

SEQ ID NO: 727 - protein, 108 aa, Artificial Sequence; identical to SEQ ID NO: 647
  source: /note="Description of Artificial Sequence: Synthetic polypeptide"

SEQ ID NO: 728 - protein, 9 aa, Artificial Sequence
  source: /note="Description of Artificial Sequence: Synthetic peptide"
GGSGGGGSG

SEQ ID NO: 729 - protein, 110 aa, Artificial Sequence; identical to SEQ ID NO: 649
  source: /note="Description of Artificial Sequence: Synthetic polypeptide"

SEQ ID NO: 730 - protein, 105 aa, Artificial Sequence; identical to SEQ ID NO: 30
  source: /note="Description of Artificial Sequence: Synthetic polypeptide"

SEQ ID NO: 731 - protein, 251 aa, Artificial Sequence; identical to SEQ ID NO: 651
  source: /note="Description of Artificial Sequence: Synthetic polypeptide"

SEQ ID NO: 732 - protein, 124 aa, Artificial Sequence; identical to SEQ ID NO: 642
  source: /note="Description of Artificial Sequence: Synthetic polypeptide"

SEQ ID NO: 733 - protein, 6 aa, Artificial Sequence
  source: /note="Description of Artificial Sequence: Synthetic peptide"
ASTKGP

SEQ ID NO: 734 - protein, 121 aa, Artificial Sequence; identical to SEQ ID NO: 644
  source: /note="Description of Artificial Sequence: Synthetic polypeptide"

SEQ ID NO: 735 - protein, 330 aa, Artificial Sequence; identical to SEQ ID NO: 725
  source: /note="Description of Artificial Sequence: Synthetic polypeptide"

SEQ ID NO: 736 - protein, 223 aa, Artificial Sequence; identical to SEQ ID NO: 656
  source: /note="Description of Artificial Sequence: Synthetic polypeptide"

SEQ ID NO: 737 - protein, 108 aa, Artificial Sequence; identical to SEQ ID NO: 647
  source: /note="Description of Artificial Sequence: Synthetic polypeptide"

SEQ ID NO: 738 - protein, 5 aa, Artificial Sequence
  source: /note="Description of Artificial Sequence: Synthetic peptide"
TVAAP

SEQ ID NO: 739 - protein, 110 aa, Artificial Sequence; identical to SEQ ID NO: 649
  source: /note="Description of Artificial Sequence: Synthetic polypeptide"

SEQ ID NO: 740 - protein, 105 aa, Artificial Sequence; identical to SEQ ID NO: 30
  source: /note="Description of Artificial Sequence: Synthetic polypeptide"

SEQ ID NO: 741 - protein, 255 aa, Artificial Sequence; identical to SEQ ID NO: 641
  source: /note="Description of Artificial Sequence: Synthetic polypeptide"

SEQ ID NO: 742 - protein, 124 aa, Artificial Sequence; identical to SEQ ID NO: 642
  source: /note="Description of Artificial Sequence: Synthetic polypeptide"

SEQ ID NO: 743 - protein, 10 aa, Artificial Sequence
  source: /note="Description of Artificial Sequence: Synthetic peptide"
GGGGSGGGGS

SEQ ID NO: 744 - protein, 121 aa, Artificial Sequence; identical to SEQ ID NO: 644
  source: /note="Description of Artificial Sequence: Synthetic polypeptide"

SEQ ID NO: 745 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 746 - protein, 227 aa, Artificial Sequence; identical to SEQ ID NO: 646
  source: /note="Description of Artificial Sequence: Synthetic polypeptide"

SEQ ID NO: 747 - protein, 108 aa, Artificial Sequence; identical to SEQ ID NO: 647
  source: /note="Description of Artificial Sequence: Synthetic polypeptide"

SEQ ID NO: 748 - protein, 9 aa, Artificial Sequence
  source: /note="Description of Artificial Sequence: Synthetic peptide"
GGSGGGGSG

SEQ ID NO: 749 - protein, 110 aa, Artificial Sequence; identical to SEQ ID NO: 649
  source: /note="Description of Artificial Sequence: Synthetic polypeptide"

SEQ ID NO: 750 - protein, 105 aa, Artificial Sequence; identical to SEQ ID NO: 30
  source: /note="Description of Artificial Sequence: Synthetic polypeptide"

SEQ ID NO: 751 - protein, 251 aa, Artificial Sequence; identical to SEQ ID NO: 651
  source: /note="Description of Artificial Sequence: Synthetic polypeptide"

SEQ ID NO: 752 - protein, 124 aa, Artificial Sequence; identical to SEQ ID NO: 642
  source: /note="Description of Artificial Sequence: Synthetic polypeptide"

SEQ ID NO: 753 - protein, 6 aa, Artificial Sequence
  source: /note="Description of Artificial Sequence: Synthetic peptide"
ASTKGP

SEQ ID NO: 754 - protein, 121 aa, Artificial Sequence; identical to SEQ ID NO: 644
  source: /note="Description of Artificial Sequence: Synthetic polypeptide"

SEQ ID NO: 755 - protein, 330 aa, Artificial Sequence; identical to SEQ ID NO: 745
  source: /note="Description of Artificial Sequence: Synthetic polypeptide"

SEQ ID NO: 756 - protein, 223 aa, Artificial Sequence; identical to SEQ ID NO: 656
  source: /note="Description of Artificial Sequence: Synthetic polypeptide"

SEQ ID NO: 757 - protein, 108 aa, Artificial Sequence; identical to SEQ ID NO: 647
  source: /note="Description of Artificial Sequence: Synthetic polypeptide"

SEQ ID NO: 758 - protein, 5 aa, Artificial Sequence
  source: /note="Description of Artificial Sequence: Synthetic peptide"
TVAAP

SEQ ID NO: 759 - protein, 110 aa, Artificial Sequence; identical to SEQ ID NO: 649
  source: /note="Description of Artificial Sequence: Synthetic polypeptide"

SEQ ID NO: 760 - protein, 105 aa, Artificial Sequence; identical to SEQ ID NO: 30
  source: /note="Description of Artificial Sequence: Synthetic polypeptide"

SEQ ID NO: 761 - protein, 248 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGASVKVSCKVSGYTLSELSIHWVRQAPGKGLEWMGGFDPEDGETIYAQKFQGRVTMTEDTSTDTAYMELSSLRSEDTAVYYCATDSAGYWYKFFQHWGQGTLVTVSS

SEQ ID NO: 762 - protein, 117 aa, Artificial Sequence; identical to SEQ ID NO: 662
  source: /note="Description of Artificial Sequence: Synthetic polypeptide"

SEQ ID NO: 763 - protein, 10 aa, Artificial Sequence
  source: /note="Description of Artificial Sequence: Synthetic peptide"
GGGGSGGGGS

SEQ ID NO: 764 - protein, 121 aa, Artificial Sequence
  source: /note="Description of Artificial Sequence: Synthetic polypeptide"
EVQLVQSGAEVKKPGASVKVSCKVSGYTLSELSIHWVRQAPGKGLEWMGGFDPEDGETIYAQKFQGRVTMTEDTSTDTAYMELSSLRSEDTAVYYCATDSAGYWYKFFQHWGQGTLVTVSS

SEQ ID NO: 765 - protein, 330 aa, Artificial Sequence; identical to SEQ ID NO: 25
  source: /note="Description of Artificial Sequence: Synthetic polypeptide"

SEQ ID NO: 766 - protein, 226 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKGGSGGGGSGQAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGSFVFGGGTKLTVLG

SEQ ID NO: 767 - protein, 107 aa, Artificial Sequence; identical to SEQ ID NO: 667
  source: /note="Description of Artificial Sequence: Synthetic polypeptide"

SEQ ID NO: 768 - protein, 9 aa, Artificial Sequence
  source: /note="Description of Artificial Sequence: Synthetic peptide"
GGSGGGGSG

SEQ ID NO: 769 - protein, 110 aa, Artificial Sequence
  source: /note="Description of Artificial Sequence: Synthetic polypeptide"
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGSFVFGGGTKLTVLG

SEQ ID NO: 770 - protein, 105 aa, Artificial Sequence; identical to SEQ ID NO: 30
  source: /note="Description of Artificial Sequence: Synthetic polypeptide"

SEQ ID NO: 771 - protein, 252 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDTVGYWEKFFQHWGQGTLVTVSS

SEQ ID NO: 772 - protein, 121 aa, Artificial Sequence [sequence omitted]

SEQ ID NO: 773 - protein, 10 aa, Artificial Sequence
  source: /note="Description of Artificial Sequence: Synthetic peptide"
GGGGSGGGGS

SEQ ID NO: 774 - protein, 121 aa, Artificial Sequence [sequence omitted]

SEQ ID NO: 775 - protein, 330 aa, Artificial Sequence; identical to SEQ ID NO: 25
  source: /note="Description of Artificial Sequence: Synthetic polypeptide"

SEQ ID NO: 776 - protein, 227 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGQAVVTQEPSLTVSPGGTVTLTCGSSTGTVTIDHYPYWFQQKPGQAPRTLISDTDDKHSWTPARFSGSLLGGKAALTLSGAQPEDEAEYYCLLDYGGRFVFGGGTKLTVLG

SEQ ID NO: 777 - protein, 108 aa, Artificial Sequence; identical to SEQ ID NO: 627
  source: /note="Description of Artificial Sequence: Synthetic polypeptide"

SEQ ID NO: 778 - protein, 9 aa, Artificial Sequence
  source: /note="Description of Artificial Sequence: Synthetic peptide"
GGSGGGGSG

SEQ ID NO: 779 - protein, 110 aa, Artificial Sequence; identical to SEQ ID NO: 649
  source: /note="Description of Artificial Sequence: Synthetic polypeptide"

SEQ ID NO: 780 - protein, 105 aa, Artificial Sequence; identical to SEQ ID NO: 30
  source: /note="Description of Artificial Sequence: Synthetic polypeptide"

SEQ ID NO: 781 - protein, 252 aa, Artificial Sequence; identical to SEQ ID NO: 771
  source: /note="Description of Artificial Sequence: Synthetic polypeptide"

SEQ ID NO: 782 - protein, 121 aa, Artificial Sequence [sequence omitted]

SEQ ID NO: 783 - protein, 10 aa, Artificial Sequence
  source: /note="Description of Artificial Sequence: Synthetic peptide"
GGGGSGGGGS

SEQ ID NO: 784 - protein, 121 aa, Artificial Sequence [sequence omitted]

SEQ ID NO: 785 - protein, 330 aa, Artificial Sequence; identical to SEQ ID NO: 25
  source: /note="Description of Artificial Sequence: Synthetic polypeptide"

SEQ ID NO: 786 - protein, 227 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRGGSGGGGSGQAVVTQEPSLTVSPGGTVTLTCGSSTGTVTIDHYPYWFQQKPGQAPRTLISDTDDKHSWTPARFSGSLLGGKAALTLSGAQPEDEAEYYCLLDYGGRFVFGGGTKLTVLG

SEQ ID NO: 787 - protein, 108 aa, Artificial Sequence; identical to SEQ ID NO: 387
  source: /note="Description of Artificial Sequence: Synthetic polypeptide"

SEQ ID NO: 788 - protein, 9 aa, Artificial Sequence
  source: /note="Description of Artificial Sequence: Synthetic peptide"
GGSGGGGSG

SEQ ID NO: 789 - protein, 110 aa, Artificial Sequence; identical to SEQ ID NO: 649
  source: /note="Description of Artificial Sequence: Synthetic polypeptide"

SEQ ID NO: 790 - protein, 105 aa, Artificial Sequence; identical to SEQ ID NO: 30
  source: /note="Description of Artificial Sequence: Synthetic polypeptide"

SEQ ID NO: 791 - protein, 250 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 792 - protein, 121 aa, Artificial Sequence [sequence omitted]

SEQ ID NO: 793 - protein, 10 aa, Artificial Sequence
  source: /note="Description of Artificial Sequence: Synthetic peptide"
GGGGSGGGGS

SEQ ID NO: 794 - protein, 119 aa, Artificial Sequence
  source: /note="Description of Artificial Sequence: Synthetic polypeptide"
EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 795 - protein, 330 aa, Artificial Sequence; identical to SEQ ID NO: 25
  source: /note="Description of Artificial Sequence: Synthetic polypeptide"

SEQ ID NO: 796 - protein, 228 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 797 - protein, 108 aa, Artificial Sequence; identical to SEQ ID NO: 627
  source: /note="Description of Artificial Sequence: Synthetic polypeptide"

SEQ ID NO: 798 - protein, 9 aa, Artificial Sequence
  source: /note="Description of Artificial Sequence: Synthetic peptide"
GGSGGGGSG

SEQ ID NO: 799 - protein, 111 aa, Artificial Sequence
  source: /note="Description of Artificial Sequence: Synthetic polypeptide"
QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 800 - protein, 105 aa, Artificial Sequence; identical to SEQ ID NO: 30
  source: /note="Description of Artificial Sequence: Synthetic polypeptide"

SEQ ID NO: 801 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 802 - protein, 121 aa, Artificial Sequence [sequence omitted]

SEQ ID NO: 803 - protein, 6 aa, Artificial Sequence
  source: /note="Description of Artificial Sequence: Synthetic peptide"
ASTKGP

SEQ ID NO: 804 - protein, 119 aa, Artificial Sequence; identical to SEQ ID NO: 794
  source: /note="Description of Artificial Sequence: Synthetic polypeptide"

SEQ ID NO: 805 - protein, 330 aa, Artificial Sequence; identical to SEQ ID NO: 25
  source: /note="Description of Artificial Sequence: Synthetic polypeptide"

SEQ ID NO: 806 - protein, 224 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 807 - protein, 108 aa, Artificial Sequence; identical to SEQ ID NO: 627
  source: /note="Description of Artificial Sequence: Synthetic polypeptide"

SEQ ID NO: 808 - protein, 5 aa, Artificial Sequence
  source: /note="Description of Artificial Sequence: Synthetic peptide"
TVAAP

SEQ ID NO: 809 - protein, 111 aa, Artificial Sequence; identical to SEQ ID NO: 799
  source: /note="Description of Artificial Sequence: Synthetic polypeptide"

SEQ ID NO: 810 - protein, 105 aa, Artificial Sequence; identical to SEQ ID NO: 30
  source: /note="Description of Artificial Sequence: Synthetic polypeptide"

SEQ ID NO: 811 - protein, 253 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 812 - protein, 121 aa, Artificial Sequence [sequence omitted]

SEQ ID NO: 813 - protein, 13 aa, Artificial Sequence
  source: /note="Description of Artificial Sequence: Synthetic peptide"
ASTKGPSVFPLAP

SEQ ID NO: 814 - protein, 119 aa, Artificial Sequence; identical to SEQ ID NO: 794
  source: /note="Description of Artificial Sequence: Synthetic polypeptide"

SEQ ID NO: 815 - protein, 330 aa, Artificial Sequence; identical to SEQ ID NO: 25
  source: /note="Description of Artificial Sequence: Synthetic polypeptide"

SEQ ID NO: 816 - protein, 231 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 817 - protein, 108 aa, Artificial Sequence; identical to SEQ ID NO: 627
  source: /note="Description of Artificial Sequence: Synthetic polypeptide"

SEQ ID NO: 818 - protein, 12 aa, Artificial Sequence
  source: /note="Description of Artificial Sequence: Synthetic peptide"
TVAAPSVFIFPP

SEQ ID NO: 819 - protein, 111 aa, Artificial Sequence; identical to SEQ ID NO: 799
  source: /note="Description of Artificial Sequence: Synthetic polypeptide"

SEQ ID NO: 820 - protein, 105 aa, Artificial Sequence; identical to SEQ ID NO: 30
  source: /note="Description of Artificial Sequence: Synthetic polypeptide"

SEQ ID NO: 821 - protein, 246 aa, Artificial Sequence; identical to SEQ ID NO: 801
  source: /note="Description of Artificial Sequence: Synthetic polypeptide"

SEQ ID NO: 822 - protein, 121 aa, Artificial Sequence [sequence omitted]

SEQ ID NO: 823 - protein, 6 aa, Artificial Sequence
  source: /note="Description of Artificial Sequence: Synthetic peptide"
ASTKGP

SEQ ID NO: 824 - protein, 119 aa, Artificial Sequence; identical to SEQ ID NO: 794
  source: /note="Description of Artificial Sequence: Synthetic polypeptide"

SEQ ID NO: 825 - protein, 330 aa, Artificial Sequence; identical to SEQ ID NO: 25
  source: /note="Description of Artificial Sequence: Synthetic polypeptide"

SEQ ID NO: 826 - protein, 231 aa, Artificial Sequence; identical to SEQ ID NO: 816
  source: /note="Description of Artificial Sequence: Synthetic polypeptide"

SEQ ID NO: 827 - protein, 108 aa, Artificial Sequence; identical to SEQ ID NO: 627
  source: /note="Description of Artificial Sequence: Synthetic polypeptide"

SEQ ID NO: 828 - protein, 12 aa, Artificial Sequence
  source: /note="Description of Artificial Sequence: Synthetic peptide"
TVAAPSVFIFPP

SEQ ID NO: 829 - protein, 111 aa, Artificial Sequence; identical to SEQ ID NO: 799
  source: /note="Description of Artificial Sequence: Synthetic polypeptide"

SEQ ID NO: 830 - protein, 105 aa, Artificial Sequence; identical to SEQ ID NO: 30
  source: /note="Description of Artificial Sequence: Synthetic polypeptide"

SEQ ID NO: 831 - protein, 253 aa, Artificial Sequence; identical to SEQ ID NO: 811
  source: /note="Description of Artificial Sequence: Synthetic polypeptide"

SEQ ID NO: 832 - protein, 121 aa, Artificial Sequence [sequence omitted]

SEQ ID NO: 833 - protein, 13 aa, Artificial Sequence
  source: /note="Description of Artificial Sequence: Synthetic peptide"
ASTKGPSVFPLAP

SEQ ID NO: 834 - protein, 119 aa, Artificial Sequence; identical to SEQ ID NO: 794
  source: /note="Description of Artificial Sequence: Synthetic polypeptide"

SEQ ID NO: 835 - protein, 330 aa, Artificial Sequence; identical to SEQ ID NO: 25
  source: /note="Description of Artificial Sequence: Synthetic polypeptide"

SEQ ID NO: 836 - protein, 224 aa, Artificial Sequence; identical to SEQ ID NO: 806
  source: /note="Description of Artificial Sequence: Synthetic polypeptide"

SEQ ID NO: 837 - protein, 108 aa, Artificial Sequence; identical to SEQ ID NO: 627
  source: /note="Description of Artificial Sequence: Synthetic polypeptide"

SEQ ID NO: 838 - protein, 5 aa, Artificial Sequence
  source: /note="Description of Artificial Sequence: Synthetic peptide"
TVAAP

SEQ ID NO: 839 - protein, 111 aa, Artificial Sequence; identical to SEQ ID NO: 799
  source: /note="Description of Artificial Sequence: Synthetic polypeptide"

SEQ ID NO: 840 - protein, 105 aa, Artificial Sequence; identical to SEQ ID NO: 30
  source: /note="Description of Artificial Sequence: Synthetic polypeptide"

SEQ ID NO: 841 - protein, 250 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 842 - protein, 121 aa, Artificial Sequence [sequence omitted]

SEQ ID NO: 843 - protein, 10 aa, Artificial Sequence
  source: /note="Description of Artificial Sequence: Synthetic peptide"
GGGGSGGGGS

SEQ ID NO: 844 - protein, 119 aa, Artificial Sequence
  source: /note="Description of Artificial Sequence: Synthetic polypeptide"
EVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 845 - protein, 330 aa, Artificial Sequence; identical to SEQ ID NO: 25
  source: /note="Description of Artificial Sequence: Synthetic polypeptide"

SEQ ID NO: 846 - protein, 229 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 847 - protein, 108 aa, Artificial Sequence; identical to SEQ ID NO: 627
  source: /note="Description of Artificial Sequence: Synthetic polypeptide"

SEQ ID NO: 848 - protein, 9 aa, Artificial Sequence
  source: /note="Description of Artificial Sequence: Synthetic peptide"
GGSGGGGSG

SEQ ID NO: 849 - protein, 112 aa, Artificial Sequence
  source: /note="Description of Artificial Sequence: Synthetic polypeptide"
QSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 850 - protein, 105 aa, Artificial Sequence; identical to SEQ ID NO: 30
  source: /note="Description of Artificial Sequence: Synthetic polypeptide"

SEQ ID NO: 851 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 852 - protein, 121 aa, Artificial Sequence [sequence omitted]

SEQ ID NO: 853 - protein, 6 aa, Artificial Sequence
  source: /note="Description of Artificial Sequence: Synthetic peptide"
ASTKGP

SEQ ID NO: 854 - protein, 119 aa, Artificial Sequence; identical to SEQ ID NO: 844
  source: /note="Description of Artificial Sequence: Synthetic polypeptide"

SEQ ID NO: 855 - protein, 330 aa, Artificial Sequence; identical to SEQ ID NO: 25
  source: /note="Description of Artificial Sequence: Synthetic polypeptide"

SEQ ID NO: 856 - protein, 225 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 857 - protein, 108 aa, Artificial Sequence; identical to SEQ ID NO: 627
  source: /note="Description of Artificial Sequence: Synthetic polypeptide"

SEQ ID NO: 858 - protein, 5 aa, Artificial Sequence
  source: /note="Description of Artificial Sequence: Synthetic peptide"
TVAAP

SEQ ID NO: 859 - protein, 112 aa, Artificial Sequence; identical to SEQ ID NO: 849
  source: /note="Description of Artificial Sequence: Synthetic polypeptide"

SEQ ID NO: 860 - protein, 105 aa, Artificial Sequence; identical to SEQ ID NO: 30
  source: /note="Description of Artificial Sequence: Synthetic polypeptide"

SEQ ID NO: 861 - protein, 253 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 862 - protein, 121 aa, Artificial Sequence [sequence omitted]

SEQ ID NO: 863 - protein, 13 aa, Artificial Sequence
  source: /note="Description of Artificial Sequence: Synthetic peptide"
ASTKGPSVFPLAP

SEQ ID NO: 864 - protein, 119 aa, Artificial Sequence; identical to SEQ ID NO: 844
  source: /note="Description of Artificial Sequence: Synthetic polypeptide"

SEQ ID NO: 865 - protein, 330 aa, Artificial Sequence; identical to SEQ ID NO: 25
  source: /note="Description of Artificial Sequence: Synthetic polypeptide"

SEQ ID NO: 866 - protein, 232 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 867 - protein, 108 aa, Artificial Sequence; identical to SEQ ID NO: 627
  source: /note="Description of Artificial Sequence: Synthetic polypeptide"

SEQ ID NO: 868 - protein, 12 aa, Artificial Sequence
  source: /note="Description of Artificial Sequence: Synthetic peptide"
TVAAPSVFIFPP

SEQ ID NO: 869 - protein, 112 aa, Artificial Sequence; identical to SEQ ID NO: 849
  source: /note="Description of Artificial Sequence: Synthetic polypeptide"

SEQ ID NO: 870 - protein, 105 aa, Artificial Sequence; identical to SEQ ID NO: 30
  source: /note="Description of Artificial Sequence: Synthetic polypeptide"

SEQ ID NO: 871 - protein, 246 aa, Artificial Sequence; identical to SEQ ID NO: 851
  source: /note="Description of Artificial Sequence: Synthetic polypeptide"

SEQ ID NO: 872 - protein, 121 aa, Artificial Sequence [sequence omitted]

SEQ ID NO: 873 - protein, 6 aa, Artificial Sequence
  source: /note="Description of Artificial Sequence: Synthetic peptide"
ASTKGP

SEQ ID NO: 874 - protein, 119 aa, Artificial Sequence; identical to SEQ ID NO: 844
  source: /note="Description of Artificial Sequence: Synthetic polypeptide"

SEQ ID NO: 875 - protein, 330 aa, Artificial Sequence; identical to SEQ ID NO: 25
  source: /note="Description of Artificial Sequence: Synthetic polypeptide"

SEQ ID NO: 876 - protein, 232 aa, Artificial Sequence; identical to SEQ ID NO: 866
  source: /note="Description of Artificial Sequence: Synthetic polypeptide"

SEQ ID NO: 877 - protein, 108 aa, Artificial Sequence; identical to SEQ ID NO: 627
  source: /note="Description of Artificial Sequence: Synthetic polypeptide"

SEQ ID NO: 878 - protein, 12 aa, Artificial Sequence
  source: /note="Description of Artificial Sequence: Synthetic peptide"
TVAAPSVFIFPP

SEQ ID NO: 879 - protein, 112 aa, Artificial Sequence; identical to SEQ ID NO: 849
  source: /note="Description of Artificial Sequence: Synthetic polypeptide"

SEQ ID NO: 880 - protein, 105 aa, Artificial Sequence; identical to SEQ ID NO: 30
  source: /note="Description of Artificial Sequence: Synthetic polypeptide"

SEQ ID NO: 881 - protein, 253 aa, Artificial Sequence; identical to SEQ ID NO: 861
  source: /note="Description of Artificial Sequence: Synthetic polypeptide"

SEQ ID NO: 882 - protein, 121 aa, Artificial Sequence [sequence omitted]

SEQ ID NO: 883 - protein, 13 aa, Artificial Sequence
  source: /note="Description of Artificial Sequence: Synthetic peptide"
ASTKGPSVFPLAP

SEQ ID NO: 884 - protein, 119 aa, Artificial Sequence; identical to SEQ ID NO: 844
  source: /note="Description of Artificial Sequence: Synthetic polypeptide"

SEQ ID NO: 885 - protein, 330 aa, Artificial Sequence; identical to SEQ ID NO: 25
  source: /note="Description of Artificial Sequence: Synthetic polypeptide"

SEQ ID NO: 886 - protein, 225 aa, Artificial Sequence; identical to SEQ ID NO: 856
  source: /note="Description of Artificial Sequence: Synthetic polypeptide"

SEQ ID NO: 887 - protein, 108 aa, Artificial Sequence; identical to SEQ ID NO: 627
  source: /note="Description of Artificial Sequence: Synthetic polypeptide"

SEQ ID NO: 888 - protein, 5 aa, Artificial Sequence
  source: /note="Description of Artificial Sequence: Synthetic peptide"
TVAAP

SEQ ID NO: 889 - protein, 112 aa, Artificial Sequence; identical to SEQ ID NO: 849
  source: /note="Description of Artificial Sequence: Synthetic polypeptide"

SEQ ID NO: 890 - protein, 105 aa, Artificial Sequence; identical to SEQ ID NO: 30
  source: /note="Description of Artificial Sequence: Synthetic polypeptide"

SEQ ID NO: 891 - protein, 250 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 892 - protein, 121 aa, Artificial Sequence [sequence omitted]

SEQ ID NO: 893 - protein, 10 aa, Artificial Sequence
  source: /note="Description of Artificial Sequence: Synthetic peptide"
GGGGSGGGGS

SEQ ID NO: 894 - protein, 119 aa, Artificial Sequence
  source: /note="Description of Artificial Sequence: Synthetic polypeptide"
EVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 895 - protein, 330 aa, Artificial Sequence; identical to SEQ ID NO: 25
  source: /note="Description of Artificial Sequence: Synthetic polypeptide"

SEQ ID NO: 896 - protein, 229 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 897 - protein, 108 aa, Artificial Sequence; identical to SEQ ID NO: 627
  source: /note="Description of Artificial Sequence: Synthetic polypeptide"

SEQ ID NO: 898 - protein, 9 aa, Artificial Sequence
  source: /note="Description of Artificial Sequence: Synthetic peptide"
GGSGGGGSG

SEQ ID NO: 899 - protein, 112 aa, Artificial Sequence
  source: /note="Description of Artificial Sequence: Synthetic polypeptide"
QSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 900 - protein, 105 aa, Artificial Sequence; identical to SEQ ID NO: 30
  source: /note="Description of Artificial Sequence: Synthetic polypeptide"

SEQ ID NO: 901 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 902 - protein, 121 aa, Artificial Sequence [sequence omitted]

SEQ ID NO: 903 - protein, 6 aa, Artificial Sequence
  source: /note="Description of Artificial Sequence: Synthetic peptide"
ASTKGP

SEQ ID NO: 904 - protein, 119 aa, Artificial Sequence; identical to SEQ ID NO: 894
  source: /note="Description of Artificial Sequence: Synthetic polypeptide"

SEQ ID NO: 905 - protein, 330 aa, Artificial Sequence; identical to SEQ ID NO: 25
  source: /note="Description of Artificial Sequence: Synthetic polypeptide"

SEQ ID NO: 906 - protein, 225 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 907 - protein, 108 aa, Artificial Sequence; identical to SEQ ID NO: 627
  source: /note="Description of Artificial Sequence: Synthetic polypeptide"

SEQ ID NO: 908 - protein, 5 aa, Artificial Sequence
  source: /note="Description of Artificial Sequence: Synthetic peptide"
TVAAP

SEQ ID NO: 909 - protein, 112 aa, Artificial Sequence; identical to SEQ ID NO: 899
  source: /note="Description of Artificial Sequence: Synthetic polypeptide"

SEQ ID NO: 910 - protein, 105 aa, Artificial Sequence; identical to SEQ ID NO: 30
  source: /note="Description of Artificial Sequence: Synthetic polypeptide"

SEQ ID NO: 911 - protein, 253 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPEVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 912 - protein, 121 aa, Artificial Sequence [sequence omitted]

SEQ ID NO: 913 - protein, 13 aa, Artificial Sequence
  source: /note="Description of Artificial Sequence: Synthetic peptide"
ASTKGPSVFPLAP

SEQ ID NO: 914 - protein, 119 aa, Artificial Sequence; identical to SEQ ID NO: 894
  source: /note="Description of Artificial Sequence: Synthetic polypeptide"

SEQ ID NO: 915 - protein, 330 aa, Artificial Sequence; identical to SEQ ID NO: 25
  source: /note="Description of Artificial Sequence: Synthetic polypeptide"

SEQ ID NO: 916 - protein, 232 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 917 - protein, 108 aa, Artificial Sequence; identical to SEQ ID NO: 627
  source: /note="Description of Artificial Sequence: Synthetic polypeptide"

SEQ ID NO: 918 - protein, 12 aa, Artificial Sequence
  source: /note="Description of Artificial Sequence: Synthetic peptide"
TVAAPSVFIFPP

SEQ ID NO: 919 - protein, 112 aa, Artificial Sequence; identical to SEQ ID NO: 899
  source: /note="Description of Artificial Sequence: Synthetic polypeptide"

SEQ ID NO: 920 - protein, 105 aa, Artificial Sequence; identical to SEQ ID NO: 30
  source: /note="Description of Artificial Sequence: Synthetic polypeptide"

SEQ ID NO: 921 - protein, 246 aa, Artificial Sequence; identical to SEQ ID NO: 901
  source: /note="Description of Artificial Sequence: Synthetic polypeptide"

SEQ ID NO: 922 - protein, 121 aa, Artificial Sequence [sequence omitted]

SEQ ID NO: 923 - protein, 6 aa, Artificial Sequence
  source: /note="Description of Artificial Sequence: Synthetic peptide"
ASTKGP

SEQ ID NO: 924 - protein, 119 aa, Artificial Sequence; identical to SEQ ID NO: 894
  source: /note="Description of Artificial Sequence: Synthetic polypeptide"

SEQ ID NO: 925 - protein, 330 aa, Artificial Sequence; identical to SEQ ID NO: 25
  source: /note="Description of Artificial Sequence: Synthetic polypeptide"

SEQ ID NO: 926 - protein, 232 aa, Artificial Sequence; identical to SEQ ID NO: 916
  source: /note="Description of Artificial Sequence: Synthetic polypeptide"

SEQ ID NO: 927 - protein, 108 aa, Artificial Sequence; identical to SEQ ID NO: 627
  source: /note="Description of Artificial Sequence: Synthetic polypeptide"

SEQ ID NO: 928 - protein, 12 aa, Artificial Sequence
  source: /note="Description of Artificial Sequence: Synthetic peptide"
TVAAPSVFIFPP

SEQ ID NO: 929 - protein, 112 aa, Artificial Sequence; identical to SEQ ID NO: 899
  source: /note="Description of Artificial Sequence: Synthetic polypeptide"

SEQ ID NO: 930 - protein, 105 aa, Artificial Sequence; identical to SEQ ID NO: 30
  source: /note="Description of Artificial Sequence: Synthetic polypeptide"

SEQ ID NO: 931 - protein, 253 aa, Artificial Sequence; identical to SEQ ID NO: 911
  source: /note="Description of Artificial Sequence: Synthetic polypeptide"

SEQ ID NO: 932 - protein, 121 aa, Artificial Sequence [sequence omitted]

SEQ ID NO: 933 - protein, 13 aa, Artificial Sequence
  source: /note="Description of Artificial Sequence: Synthetic peptide"
ASTKGPSVFPLAP

SEQ ID NO: 934 - protein, 119 aa, Artificial Sequence; identical to SEQ ID NO: 894
  source: /note="Description of Artificial Sequence: Synthetic polypeptide"

SEQ ID NO: 935 - protein, 330 aa, Artificial Sequence; identical to SEQ ID NO: 25
  source: /note="Description of Artificial Sequence: Synthetic polypeptide"

SEQ ID NO: 936 - protein, 225 aa, Artificial Sequence; identical to SEQ ID NO: 906
  source: /note="Description of Artificial Sequence: Synthetic polypeptide"

SEQ ID NO: 937 - protein, 108 aa, Artificial Sequence; identical to SEQ ID NO: 627
  source: /note="Description of Artificial Sequence: Synthetic polypeptide"

SEQ ID NO: 938 - protein, 5 aa, Artificial Sequence
  source: /note="Description of Artificial Sequence: Synthetic peptide"
TVAAP

SEQ ID NO: 939 - protein, 112 aa, Artificial Sequence; identical to SEQ ID NO: 899
  source: /note="Description of Artificial Sequence: Synthetic polypeptide"

SEQ ID NO: 940 - protein, 105 aa, Artificial Sequence; identical to SEQ ID NO: 30
  source: /note="Description of Artificial Sequence: Synthetic polypeptide"

SEQ ID NO: 941 - protein, 250 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 942 - protein, 121 aa, Artificial Sequence [sequence omitted]

SEQ ID NO: 943 - protein, 10 aa, Artificial Sequence
  source: /note="Description of Artificial Sequence: Synthetic peptide"
GGGGSGGGGS

SEQ ID NO: 944 - protein, 119 aa, Artificial Sequence
  source: /note="Description of Artificial Sequence: Synthetic polypeptide"
EVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 945 - protein, 330 aa, Artificial Sequence; identical to SEQ ID NO: 25
  source: /note="Description of Artificial Sequence: Synthetic polypeptide"

SEQ ID NO: 946 - protein, 228 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 947 - protein, 108 aa, Artificial Sequence; identical to SEQ ID NO: 627
  source: /note="Description of Artificial Sequence: Synthetic polypeptide"

SEQ ID NO: 948 - protein, 9 aa, Artificial Sequence
  source: /note="Description of Artificial Sequence: Synthetic peptide"
GGSGGGGSG

SEQ ID NO: 949 - protein, 111 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 950 - protein, 105 aa, Artificial Sequence; identical to SEQ ID NO: 30
  source: /note="Description of Artificial Sequence: Synthetic polypeptide"

SEQ ID NO: 951 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 952 - protein, 121 aa, Artificial Sequence [sequence omitted]

SEQ ID NO: 953 - protein, 6 aa, Artificial Sequence
  source: /note="Description of Artificial Sequence: Synthetic peptide"
ASTKGP

SEQ ID NO: 954 - protein, 119 aa, Artificial Sequence; identical to SEQ ID NO: 944
  source: /note="Description of Artificial Sequence: Synthetic polypeptide"

SEQ ID NO: 955 - protein, 330 aa, Artificial Sequence; identical to SEQ ID NO: 25
  source: /note="Description of Artificial Sequence: Synthetic polypeptide"

SEQ ID NO: 956 - protein, 224 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 957 - protein, 108 aa, Artificial Sequence; identical to SEQ ID NO: 627
  source: /note="Description of Artificial Sequence: Synthetic polypeptide"

SEQ ID NO: 958 - protein, 5 aa, Artificial Sequence
  source: /note="Description of Artificial Sequence: Synthetic peptide"
TVAAP

SEQ ID NO: 959 - protein, 111 aa, Artificial Sequence; identical to SEQ ID NO: 949
  source: /note="Description of Artificial Sequence: Synthetic polypeptide"

SEQ ID NO: 960 - protein, 105 aa, Artificial Sequence; identical to SEQ ID NO: 30
  source: /note="Description of Artificial Sequence: Synthetic polypeptide"

SEQ ID NO: 961 - protein, 253 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 962 - protein, 121 aa, Artificial Sequence [sequence omitted]

SEQ ID NO: 963 - protein, 13 aa, Artificial Sequence
  source: /note="Description of Artificial Sequence: Synthetic peptide"
ASTKGPSVFPLAP

SEQ ID NO: 964 - protein, 119 aa, Artificial Sequence; identical to SEQ ID NO: 944
  source: /note="Description of Artificial Sequence: Synthetic polypeptide"

SEQ ID NO: 965 - protein, 330 aa, Artificial Sequence; identical to SEQ ID NO: 25
  source: /note="Description of Artificial Sequence: Synthetic polypeptide"

SEQ ID NO: 966 - protein, 231 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 967 - protein, 108 aa, Artificial Sequence; identical to SEQ ID NO: 627
  source: /note="Description of Artificial Sequence: Synthetic polypeptide"

SEQ ID NO: 968 - protein, 12 aa, Artificial Sequence
  source: /note="Description of Artificial Sequence: Synthetic peptide"
TVAAPSVFIFPP

SEQ ID NO: 969 - protein, 111 aa, Artificial Sequence; identical to SEQ ID NO: 949
  source: /note="Description of Artificial Sequence: Synthetic polypeptide"

SEQ ID NO: 970 - protein, 105 aa, Artificial Sequence; identical to SEQ ID NO: 30
  source: /note="Description of Artificial Sequence: Synthetic polypeptide"

SEQ ID NO: 971 - protein, 246 aa, Artificial Sequence; identical to SEQ ID NO: 951
  source: /note="Description of Artificial Sequence: Synthetic polypeptide"

SEQ ID NO: 972 - protein, 121 aa, Artificial Sequence [sequence omitted]

SEQ ID NO: 973 - protein, 6 aa, Artificial Sequence
  source: /note="Description of Artificial Sequence: Synthetic peptide"
ASTKGP

SEQ ID NO: 974 - protein, 119 aa, Artificial Sequence; identical to SEQ ID NO: 944
  source: /note="Description of Artificial Sequence: Synthetic polypeptide"

SEQ ID NO: 975 - protein, 330 aa, Artificial Sequence; identical to SEQ ID NO: 25
  source: /note="Description of Artificial Sequence: Synthetic polypeptide"

SEQ ID NO: 976 - protein, 231 aa, Artificial Sequence; identical to SEQ ID NO: 966
  source: /note="Description of Artificial Sequence: Synthetic polypeptide"

SEQ ID NO: 977 - protein, 108 aa, Artificial Sequence; identical to SEQ ID NO: 627
  source: /note="Description of Artificial Sequence: Synthetic polypeptide"

SEQ ID NO: 978 - protein, 12 aa, Artificial Sequence
  source: /note="Description of Artificial Sequence: Synthetic peptide"
TVAAPSVFIFPP

SEQ ID NO: 979 - protein, 111 aa, Artificial Sequence; identical to SEQ ID NO: 949
  source: /note="Description of Artificial Sequence: Synthetic polypeptide"

SEQ ID NO: 980 - protein, 105 aa, Artificial Sequence; identical to SEQ ID NO: 30
  source: /note="Description of Artificial Sequence: Synthetic polypeptide"

SEQ ID NO: 981 - protein, 253 aa, Artificial Sequence; identical to SEQ ID NO: 961
  source: /note="Description of Artificial Sequence: Synthetic polypeptide"

SEQ ID NO: 982 - protein, 121 aa, Artificial Sequence [sequence omitted]

SEQ ID NO: 983 - protein, 13 aa, Artificial Sequence
  source: /note="Description of Artificial Sequence: Synthetic peptide"
ASTKGPSVFPLAP

SEQ ID NO: 984 - protein, 119 aa, Artificial Sequence; identical to SEQ ID NO: 944
  source: /note="Description of Artificial Sequence: Synthetic polypeptide"

SEQ ID NO: 985 - protein, 330 aa, Artificial Sequence; identical to SEQ ID NO: 25
  source: /note="Description of Artificial Sequence: Synthetic polypeptide"

SEQ ID NO: 986 - protein, 224 aa, Artificial Sequence; identical to SEQ ID NO: 956
  source: /note="Description of Artificial Sequence: Synthetic polypeptide"

SEQ ID NO: 987 - protein, 108 aa, Artificial Sequence; identical to SEQ ID NO: 627
  source: /note="Description of Artificial Sequence: Synthetic polypeptide"

SEQ ID NO: 988 - protein, 5 aa, Artificial Sequence
  source: /note="Description of Artificial Sequence: Synthetic peptide"
TVAAP

SEQ ID NO: 989 - protein, 111 aa, Artificial Sequence; identical to SEQ ID NO: 949
  source: /note="Description of Artificial Sequence: Synthetic polypeptide"

SEQ ID NO: 990 - protein, 105 aa, Artificial Sequence; identical to SEQ ID NO: 30
  source: /note="Description of Artificial Sequence: Synthetic polypeptide"

SEQ ID NO: 991 - protein, 250 aa, Artificial Sequence; identical to SEQ ID NO: 791
  source: /note="Description of Artificial Sequence: Synthetic polypeptide"

SEQ ID NO: 992 - protein, 121 aa, Artificial Sequence [sequence omitted]

SEQ ID NO: 993 - protein, 10 aa, Artificial Sequence
  source: /note="Description of Artificial Sequence: Synthetic peptide"
GGGGSGGGGS

SEQ ID NO: 994 - protein, 119 aa, Artificial Sequence; identical to SEQ ID NO: 794
  source: /note="Description of Artificial Sequence: Synthetic polypeptide"

SEQ ID NO: 995 - protein, 330 aa, Artificial Sequence; identical to SEQ ID NO: 25
  source: /note="Description of Artificial Sequence: Synthetic polypeptide"

SEQ ID NO: 996 - protein, 228 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRGGSGGGGSGQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 997 - protein, 108 aa, Artificial Sequence; identical to SEQ ID NO: 387
  source: /note="Description of Artificial Sequence: Synthetic polypeptide"

SEQ ID NO: 998 - protein, 9 aa, Artificial Sequence
  source: /note="Description of Artificial Sequence: Synthetic peptide"
GGSGGGGSG

SEQ ID NO: 999 - protein, 111 aa, Artificial Sequence; identical to SEQ ID NO: 799
  source: /note="Description of Artificial Sequence: Synthetic polypeptide"

SEQ ID NO: 1000 - protein, 105 aa, Artificial Sequence; identical to SEQ ID NO: 30
  source: /note="Description of Artificial Sequence: Synthetic polypeptide"

SEQ ID NO: 1001 - protein, 246 aa, Artificial Sequence; identical to SEQ ID NO: 801
  source: /note="Description of Artificial Sequence: Synthetic polypeptide"

SEQ ID NO: 1002 - protein, 121 aa, Artificial Sequence [sequence omitted]

SEQ ID NO: 1003 - protein, 6 aa, Artificial Sequence
  source: /note="Description of Artificial Sequence: Synthetic peptide"
ASTKGP

SEQ ID NO: 1004 - protein, 119 aa, Artificial Sequence; identical to SEQ ID NO: 794
  source: /note="Description of Artificial Sequence: Synthetic polypeptide"

SEQ ID NO: 1005 - protein, 330 aa, Artificial Sequence; identical to SEQ ID NO: 25
  source: /note="Description of Artificial Sequence: Synthetic polypeptide"

SEQ ID NO: 1006 - protein, 224 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 1007 - protein, 108 aa, Artificial Sequence; identical to SEQ ID NO: 387
  source: /note="Description of Artificial Sequence: Synthetic polypeptide"

SEQ ID NO: 1008 - protein, 5 aa, Artificial Sequence
  source: /note="Description of Artificial Sequence: Synthetic peptide"
TVAAP

SEQ ID NO: 1009 - protein, 111 aa, Artificial Sequence; identical to SEQ ID NO: 799
  source: /note="Description of Artificial Sequence: Synthetic polypeptide"

SEQ ID NO: 1010 - protein, 105 aa, Artificial Sequence; identical to SEQ ID NO: 30
  source: /note="Description of Artificial Sequence: Synthetic polypeptide"

SEQ ID NO: 1011 - protein, 253 aa, Artificial Sequence; identical to SEQ ID NO: 811
  source: /note="Description of Artificial Sequence: Synthetic polypeptide"

SEQ ID NO: 1012 - protein, 121 aa, Artificial Sequence [sequence omitted]

SEQ ID NO: 1013 - protein, 13 aa, Artificial Sequence
  source: /note="Description of Artificial Sequence: Synthetic peptide"
ASTKGPSVFPLAP

SEQ ID NO: 1014 - protein, 119 aa, Artificial Sequence; identical to SEQ ID NO: 794
  source: /note="Description of Artificial Sequence: Synthetic polypeptide"

SEQ ID NO: 1015 - protein, 330 aa, Artificial Sequence; identical to SEQ ID NO: 25
  source: /note="Description of Artificial Sequence: Synthetic polypeptide"

SEQ ID NO: 1016 - protein, 231 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPSVFIFPPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 1017 - protein, 108 aa, Artificial Sequence; identical to SEQ ID NO: 387
  source: /note="Description of Artificial Sequence: Synthetic polypeptide"

SEQ ID NO: 1018 - protein, 12 aa, Artificial Sequence
  source: /note="Description of Artificial Sequence: Synthetic peptide"
TVAAPSVFIFPP

SEQ ID NO: 1019 - protein, 111 aa, Artificial Sequence; identical to SEQ ID NO: 799
  source: /note="Description of Artificial Sequence: Synthetic polypeptide"

SEQ ID NO: 1020 - protein, 105 aa, Artificial Sequence; identical to SEQ ID NO: 30
  source: /note="Description of Artificial Sequence: Synthetic polypeptide"

SEQ ID NO: 1021 - protein, 246 aa, Artificial Sequence; identical to SEQ ID NO: 801
  source: /note="Description of Artificial Sequence: Synthetic polypeptide"

SEQ ID NO: 1022 - protein, 121 aa, Artificial Sequence [sequence omitted]

SEQ ID NO: 1023 - protein, 6 aa, Artificial Sequence
  source: /note="Description of Artificial Sequence: Synthetic peptide"
ASTKGP

SEQ ID NO: 1024 - protein, 119 aa, Artificial Sequence; identical to SEQ ID NO: 794
  source: /note="Description of Artificial Sequence: Synthetic polypeptide"

SEQ ID NO: 1025 - protein, 330 aa, Artificial Sequence; identical to SEQ ID NO: 25
  source: /note="Description of Artificial Sequence: Synthetic polypeptide"

SEQ ID NO: 1026 - protein, 231 aa, Artificial Sequence; identical to SEQ ID NO: 1016
  source: /note="Description of Artificial Sequence: Synthetic polypeptide"

SEQ ID NO: 1027 - protein, 108 aa, Artificial Sequence; identical to SEQ ID NO: 387
  source: /note="Description of Artificial Sequence: Synthetic polypeptide"

SEQ ID NO: 1028 - protein, 12 aa, Artificial Sequence
  source: /note="Description of Artificial Sequence: Synthetic peptide"
TVAAPSVFIFPP

SEQ ID NO: 1029 - protein, 111 aa, Artificial Sequence; identical to SEQ ID NO: 799
  source: /note="Description of Artificial Sequence: Synthetic polypeptide"

SEQ ID NO: 1030 - protein, 105 aa, Artificial Sequence; identical to SEQ ID NO: 30
  source: /note="Description of Artificial Sequence: Synthetic polypeptide"

SEQ ID NO: 1031 - protein, 253 aa, Artificial Sequence; identical to SEQ ID NO: 811
  source: /note="Description of Artificial Sequence: Synthetic polypeptide"

SEQ ID NO: 1032 - protein, 121 aa, Artificial Sequence [sequence omitted]

SEQ ID NO: 1033 - protein, 13 aa, Artificial Sequence
  source: /note="Description of Artificial Sequence: Synthetic peptide"
ASTKGPSVFPLAP

SEQ ID NO: 1034 - protein, 119 aa, Artificial Sequence; identical to SEQ ID NO: 794
  source: /note="Description of Artificial Sequence: Synthetic polypeptide"

SEQ ID NO: 1035 - protein, 330 aa, Artificial Sequence; identical to SEQ ID NO: 25
  source: /note="Description of Artificial Sequence: Synthetic polypeptide"

SEQ ID NO: 1036 - protein, 224 aa, Artificial Sequence; identical to SEQ ID NO: 1006
  source: /note="Description of Artificial Sequence: Synthetic polypeptide"

SEQ ID NO: 1037 - protein, 108 aa, Artificial Sequence; identical to SEQ ID NO: 387
  source: /note="Description of Artificial Sequence: Synthetic polypeptide"

SEQ ID NO: 1038 - protein, 5 aa, Artificial Sequence
  source: /note="Description of Artificial Sequence: Synthetic peptide"
TVAAP

SEQ ID NO: 1039 - protein, 111 aa, Artificial Sequence; identical to SEQ ID NO: 799
  source: /note="Description of Artificial Sequence: Synthetic polypeptide"

SEQ ID NO: 1040 - protein, 105 aa, Artificial Sequence; identical to SEQ ID NO: 30
  source: /note="Description of Artificial Sequence: Synthetic polypeptide"

SEQ ID NO: 1041 - protein, 250 aa, Artificial Sequence; identical to SEQ ID NO: 841
  source: /note="Description of Artificial Sequence: Synthetic polypeptide"

SEQ ID NO: 1042 - protein, 121 aa, Artificial Sequence [sequence omitted]

SEQ ID NO: 1043 - protein, 10 aa, Artificial Sequence
  source: /note="Description of Artificial Sequence: Synthetic peptide"
GGGGSGGGGS

SEQ ID NO: 1044 - protein, 119 aa, Artificial Sequence; identical to SEQ ID NO: 844
  source: /note="Description of Artificial Sequence: Synthetic polypeptide"

SEQ ID NO: 1045 - protein, 330 aa, Artificial Sequence; identical to SEQ ID NO: 25
  source: /note="Description of Artificial Sequence: Synthetic polypeptide"

SEQ ID NO: 1046 - protein, 229 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRGGSGGGGSGQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 1047 - protein, 108 aa, Artificial Sequence; identical to SEQ ID NO: 387
  source: /note="Description of Artificial Sequence: Synthetic polypeptide"

SEQ ID NO: 1048 - protein, 9 aa, Artificial Sequence
  source: /note="Description of Artificial Sequence: Synthetic peptide"
GGSGGGGSG

SEQ ID NO: 1049 - protein, 112 aa, Artificial Sequence; identical to SEQ ID NO: 849
  source: /note="Description of Artificial Sequence: Synthetic polypeptide"

SEQ ID NO: 1050 - protein, 105 aa, Artificial Sequence; identical to SEQ ID NO: 30
  source: /note="Description of Artificial Sequence: Synthetic polypeptide"

SEQ ID NO: 1051 - protein, 246 aa, Artificial Sequence; identical to SEQ ID NO: 851
  source: /note="Description of Artificial Sequence: Synthetic polypeptide"

SEQ ID NO: 1052 - protein, 121 aa, Artificial Sequence [sequence omitted]

SEQ ID NO: 1053 - protein, 6 aa, Artificial Sequence
  source: /note="Description of Artificial Sequence: Synthetic peptide"
ASTKGP

SEQ ID NO: 1054 - protein, 119 aa, Artificial Sequence; identical to SEQ ID NO: 844
  source: /note="Description of Artificial Sequence: Synthetic polypeptide"

SEQ ID NO: 1055 - protein, 330 aa, Artificial Sequence; identical to SEQ ID NO: 25
  source: /note="Description of Artificial Sequence: Synthetic polypeptide"

SEQ ID NO: 1056 - protein, 225 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 1057 - protein, 108 aa, Artificial Sequence; identical to SEQ ID NO: 387
  source: /note="Description of Artificial Sequence: Synthetic polypeptide"

SEQ ID NO: 1058 - protein, 5 aa, Artificial Sequence
  source: /note="Description of Artificial Sequence: Synthetic peptide"
TVAAP

SEQ ID NO: 1059 - protein, 112 aa, Artificial Sequence; identical to SEQ ID NO: 849
  source: /note="Description of Artificial Sequence: Synthetic polypeptide"

SEQ ID NO: 1060 - protein, 105 aa, Artificial Sequence; identical to SEQ ID NO: 30
  source: /note="Description of Artificial Sequence: Synthetic polypeptide"

SEQ ID NO: 1061 - protein, 253 aa, Artificial Sequence; identical to SEQ ID NO: 861
  source: /note="Description of Artificial Sequence: Synthetic polypeptide"

SEQ ID NO: 1062 - protein, 121 aa, Artificial Sequence [sequence omitted]

SEQ ID NO: 1063 - protein, 13 aa, Artificial Sequence
  source: /note="Description of Artificial Sequence: Synthetic peptide"
ASTKGPSVFPLAP

SEQ ID NO: 1064 - protein, 119 aa, Artificial Sequence; identical to SEQ ID NO: 844
  source: /note="Description of Artificial Sequence: Synthetic polypeptide"

SEQ ID NO: 1065 - protein, 330 aa, Artificial Sequence; identical to SEQ ID NO: 25
  source: /note="Description of Artificial Sequence: Synthetic polypeptide"

SEQ ID NO: 1066 - protein, 232 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPSVFIFPPQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 1067 - protein, 108 aa, Artificial Sequence; identical to SEQ ID NO: 387
  source: /note="Description of Artificial Sequence: Synthetic polypeptide"

SEQ ID NO: 1068 - protein, 12 aa, Artificial Sequence
  source: /note="Description of Artificial Sequence: Synthetic peptide"
TVAAPSVFIFPP

SEQ ID NO: 1069 - protein, 112 aa, Artificial Sequence; identical to SEQ ID NO: 849
  source: /note="Description of Artificial Sequence: Synthetic polypeptide"

SEQ ID NO: 1070 - protein, 105 aa, Artificial Sequence; identical to SEQ ID NO: 30
  source: /note="Description of Artificial Sequence: Synthetic polypeptide"

SEQ ID NO: 1071 - protein, 246 aa, Artificial Sequence; identical to SEQ ID NO: 851
  source: /note="Description of Artificial Sequence: Synthetic polypeptide"

SEQ ID NO: 1072 - protein, 121 aa, Artificial Sequence [sequence omitted]

SEQ ID NO: 1073 - protein, 6 aa, Artificial Sequence
  source: /note="Description of Artificial Sequence: Synthetic peptide"
ASTKGP

SEQ ID NO: 1074 - protein, 119 aa, Artificial Sequence; identical to SEQ ID NO: 844
  source: /note="Description of Artificial Sequence: Synthetic polypeptide"

SEQ ID NO: 1075 - protein, 330 aa, Artificial Sequence; identical to SEQ ID NO: 25
  source: /note="Description of Artificial Sequence: Synthetic polypeptide"

SEQ ID NO: 1076 - protein, 232 aa, Artificial Sequence; identical to SEQ ID NO: 1066
  source: /note="Description of Artificial Sequence: Synthetic polypeptide"

SEQ ID NO: 1077 - protein, 108 aa, Artificial Sequence; identical to SEQ ID NO: 387
  source: /note="Description of Artificial Sequence: Synthetic polypeptide"

SEQ ID NO: 1078 - protein, 12 aa, Artificial Sequence
  source: /note="Description of Artificial Sequence: Synthetic peptide"
TVAAPSVFIFPP

SEQ ID NO: 1079 - protein, 112 aa, Artificial Sequence; identical to SEQ ID NO: 849
  source: /note="Description of Artificial Sequence: Synthetic polypeptide"

SEQ ID NO: 1080 - protein, 105 aa, Artificial Sequence; identical to SEQ ID NO: 30
  source: /note="Description of Artificial Sequence: Synthetic polypeptide"

SEQ ID NO: 1081 - protein, 253 aa, Artificial Sequence; identical to SEQ ID NO: 861
  source: /note="Description of Artificial Sequence: Synthetic polypeptide"

SEQ ID NO: 1082 - protein, 121 aa, Artificial Sequence [sequence omitted]

SEQ ID NO: 1083 - protein, 13 aa, Artificial Sequence
  source: /note="Description of Artificial Sequence: Synthetic peptide"
ASTKGPSVFPLAP

SEQ ID NO: 1084 - protein, 119 aa, Artificial Sequence; identical to SEQ ID NO: 844
  source: /note="Description of Artificial Sequence: Synthetic polypeptide"

SEQ ID NO: 1085 - protein, 330 aa, Artificial Sequence; identical to SEQ ID NO: 25
  source: /note="Description of Artificial Sequence: Synthetic polypeptide"

SEQ ID NO: 1086 - protein, 225 aa, Artificial Sequence; identical to SEQ ID NO: 1056
  source: /note="Description of Artificial Sequence: Synthetic polypeptide"

SEQ ID NO: 1087 - protein, 108 aa, Artificial Sequence; identical to SEQ ID NO: 387
  source: /note="Description of Artificial Sequence: Synthetic polypeptide"

SEQ ID NO: 1088 - protein, 5 aa, Artificial Sequence
  source: /note="Description of Artificial Sequence: Synthetic peptide"
TVAAP

SEQ ID NO: 1089 - protein, 112 aa, Artificial Sequence; identical to SEQ ID NO: 849
  source: /note="Description of Artificial Sequence: Synthetic polypeptide"

SEQ ID NO: 1090 - protein, 105 aa, Artificial Sequence; identical to SEQ ID NO: 30
  source: /note="Description of Artificial Sequence: Synthetic polypeptide"

SEQ ID NO: 1091 - protein, 250 aa, Artificial Sequence; identical to SEQ ID NO: 891
  source: /note="Description of Artificial Sequence: Synthetic polypeptide"

SEQ ID NO: 1092 - protein, 121 aa, Artificial Sequence [sequence omitted]

SEQ ID NO: 1093 - protein, 10 aa, Artificial Sequence
  source: /note="Description of Artificial Sequence: Synthetic peptide"
GGGGSGGGGS

SEQ ID NO: 1094 - protein, 119 aa, Artificial Sequence; identical to SEQ ID NO: 894
  source: /note="Description of Artificial Sequence: Synthetic polypeptide"

SEQ ID NO: 1095 - protein, 330 aa, Artificial Sequence; identical to SEQ ID NO: 25
  source: /note="Description of Artificial Sequence: Synthetic polypeptide"

SEQ ID NO: 1096 - protein, 229 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRGGSGGGGSGQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 1097 - protein, 108 aa, Artificial Sequence; identical to SEQ ID NO: 387
  source: /note="Description of Artificial Sequence: Synthetic polypeptide"

SEQ ID NO: 1098 - protein, 9 aa, Artificial Sequence
  source: /note="Description of Artificial Sequence: Synthetic peptide"
GGSGGGGSG

SEQ ID NO: 1099 - protein, 112 aa, Artificial Sequence; identical to SEQ ID NO: 899
  source: /note="Description of Artificial Sequence: Synthetic polypeptide"

SEQ ID NO: 1100 - protein, 105 aa, Artificial Sequence; identical to SEQ ID NO: 30
  source: /note="Description of Artificial Sequence: Synthetic polypeptide"

SEQ ID NO: 1101 - protein, 246 aa, Artificial Sequence; identical to SEQ ID NO: 901
  source: /note="Description of Artificial Sequence: Synthetic polypeptide"

SEQ ID NO: 1102 - protein, 121 aa, Artificial Sequence [sequence omitted]

SEQ ID NO: 1103 - protein, 6 aa, Artificial Sequence
  source: /note="Description of Artificial Sequence: Synthetic peptide"
ASTKGP

SEQ ID NO: 1104 - protein, 119 aa, Artificial Sequence; identical to SEQ ID NO: 894
  source: /note="Description of Artificial Sequence: Synthetic polypeptide"

SEQ ID NO: 1105 - protein, 330 aa, Artificial Sequence; identical to SEQ ID NO: 25
  source: /note="Description of Artificial Sequence: Synthetic polypeptide"

SEQ ID NO: 1106 - protein, 225 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 1107 - protein, 108 aa, Artificial Sequence; identical to SEQ ID NO: 387
  source: /note="Description of Artificial Sequence: Synthetic polypeptide"

SEQ ID NO: 1108 - protein, 5 aa, Artificial Sequence
  source: /note="Description of Artificial Sequence: Synthetic peptide"
TVAAP

SEQ ID NO: 1109 - protein, 112 aa, Artificial Sequence; identical to SEQ ID NO: 899
  source: /note="Description of Artificial Sequence: Synthetic polypeptide"

SEQ ID NO: 1110 - protein, 105 aa, Artificial Sequence; identical to SEQ ID NO: 30
  source: /note="Description of Artificial Sequence: Synthetic polypeptide"

SEQ ID NO: 1111 - protein, 253 aa, Artificial Sequence; identical to SEQ ID NO: 911
  source: /note="Description of Artificial Sequence: Synthetic polypeptide"

SEQ ID NO: 1112 - protein, 121 aa, Artificial Sequence [sequence omitted]

SEQ ID NO: 1113 - protein, 13 aa, Artificial Sequence
  source: /note="Description of Artificial Sequence: Synthetic peptide"
ASTKGPSVFPLAP

SEQ ID NO: 1114 - protein, 119 aa, Artificial Sequence; identical to SEQ ID NO: 894
  source: /note="Description of Artificial Sequence: Synthetic polypeptide"

SEQ ID NO: 1115 - protein, 330 aa, Artificial Sequence; identical to SEQ ID NO: 25
  source: /note="Description of Artificial Sequence: Synthetic polypeptide"

SEQ ID NO: 1116 - protein, 232 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPSVFIFPPQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 1117 - protein, 108 aa, Artificial Sequence; identical to SEQ ID NO: 387
  source: /note="Description of Artificial Sequence: Synthetic polypeptide"

SEQ ID NO: 1118 - protein, 12 aa, Artificial Sequence
  source: /note="Description of Artificial Sequence: Synthetic peptide"
TVAAPSVFIFPP

SEQ ID NO: 1119 - protein, 112 aa, Artificial Sequence; identical to SEQ ID NO: 899
  source: /note="Description of Artificial Sequence: Synthetic polypeptide"

SEQ ID NO: 1120 - protein, 105 aa, Artificial Sequence; identical to SEQ ID NO: 30
  source: /note="Description of Artificial Sequence: Synthetic polypeptide"

SEQ ID NO: 1121 - protein, 246 aa, Artificial Sequence; identical to SEQ ID NO: 901
  source: /note="Description of Artificial Sequence: Synthetic polypeptide"

SEQ ID NO: 1122 - protein, 121 aa, Artificial Sequence [sequence omitted]

SEQ ID NO: 1123 - protein, 6 aa, Artificial Sequence
  source: /note="Description of Artificial Sequence: Synthetic peptide"
ASTKGP

SEQ ID NO: 1124 - protein, 119 aa, Artificial Sequence; identical to SEQ ID NO: 894
  source: /note="Description of Artificial Sequence: Synthetic polypeptide"

SEQ ID NO: 1125 - protein, 330 aa, Artificial Sequence; identical to SEQ ID NO: 25
  source: /note="Description of Artificial Sequence: Synthetic polypeptide"

SEQ ID NO: 1126 - protein, 232 aa, Artificial Sequence; identical to SEQ ID NO: 1116
  source: /note="Description of Artificial Sequence: Synthetic polypeptide"

SEQ ID NO: 1127 - protein, 108 aa, Artificial Sequence; identical to SEQ ID NO: 387
  source: /note="Description of Artificial Sequence: Synthetic polypeptide"

SEQ ID NO: 1128 - protein, 12 aa, Artificial Sequence
  source: /note="Description of Artificial Sequence: Synthetic peptide"
TVAAPSVFIFPP

SEQ ID NO: 1129 - protein, 112 aa, Artificial Sequence; identical to SEQ ID NO: 899
  source: /note="Description of Artificial Sequence: Synthetic polypeptide"

SEQ ID NO: 1130 - protein, 105 aa, Artificial Sequence; identical to SEQ ID NO: 30
  source: /note="Description of Artificial Sequence: Synthetic polypeptide"

SEQ ID NO: 1131 - protein, 253 aa, Artificial Sequence; identical to SEQ ID NO: 911
  source: /note="Description of Artificial Sequence: Synthetic polypeptide"

SEQ ID NO: 1132 - protein, 121 aa, Artificial Sequence [sequence omitted]

SEQ ID NO: 1133 - protein, 13 aa, Artificial Sequence
  source: /note="Description of Artificial Sequence: Synthetic peptide"
ASTKGPSVFPLAP

SEQ ID NO: 1134 - protein, 119 aa, Artificial Sequence; identical to SEQ ID NO: 894
  source: /note="Description of Artificial Sequence: Synthetic polypeptide"

SEQ ID NO: 1135 - protein, 330 aa, Artificial Sequence; identical to SEQ ID NO: 25
  source: /note="Description of Artificial Sequence: Synthetic polypeptide"

SEQ ID NO: 1136 - protein, 225 aa, Artificial Sequence; identical to SEQ ID NO: 1106
  source: /note="Description of Artificial Sequence: Synthetic polypeptide"

SEQ ID NO: 1137 - protein, 108 aa, Artificial Sequence; identical to SEQ ID NO: 387
  source: /note="Description of Artificial Sequence: Synthetic polypeptide"

SEQ ID NO: 1138 - protein, 5 aa, Artificial Sequence
  source: /note="Description of Artificial Sequence: Synthetic peptide"
TVAAP

SEQ ID NO: 1139 - protein, 112 aa, Artificial Sequence; identical to SEQ ID NO: 899
  source: /note="Description of Artificial Sequence: Synthetic polypeptide"

SEQ ID NO: 1140 - protein, 105 aa, Artificial Sequence; identical to SEQ ID NO: 30
  source: /note="Description of Artificial Sequence: Synthetic polypeptide"

SEQ ID NO: 1141 - protein, 250 aa, Artificial Sequence; identical to SEQ ID NO: 941
  source: /note="Description of Artificial Sequence: Synthetic polypeptide"

SEQ ID NO: 1142 - protein, 121 aa, Artificial Sequence [sequence omitted]

SEQ ID NO: 1143 - protein, 10 aa, Artificial Sequence
  source: /note="Description of Artificial Sequence: Synthetic peptide"
GGGGSGGGGS

SEQ ID NO: 1144 - protein, 119 aa, Artificial Sequence; identical to SEQ ID NO: 944
  source: /note="Description of Artificial Sequence: Synthetic polypeptide"

SEQ ID NO: 1145 - protein, 330 aa, Artificial Sequence; identical to SEQ ID NO: 25
  source: /note="Description of Artificial Sequence: Synthetic polypeptide"

SEQ ID NO: 1146 - protein, 228 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRGGSGGGGSGQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 1147 - protein, 108 aa, Artificial Sequence; identical to SEQ ID NO: 387
  source: /note="Description of Artificial Sequence: Synthetic polypeptide"

SEQ ID NO: 1148 - protein, 9 aa, Artificial Sequence
  source: /note="Description of Artificial Sequence: Synthetic peptide"
GGSGGGGSG

SEQ ID NO: 1149 - protein, 111 aa, Artificial Sequence; identical to SEQ ID NO: 949
  source: /note="Description of Artificial Sequence: Synthetic polypeptide"

SEQ ID NO: 1150 - protein, 105 aa, Artificial Sequence; identical to SEQ ID NO: 30
  source: /note="Description of Artificial Sequence: Synthetic polypeptide"

SEQ ID NO: 1151 - protein, 246 aa, Artificial Sequence; identical to SEQ ID NO: 951
  source: /note="Description of Artificial Sequence: Synthetic polypeptide"

SEQ ID NO: 1152 - protein, 121 aa, Artificial Sequence [sequence omitted]

SEQ ID NO: 1153 - protein, 6 aa, Artificial Sequence
  source: /note="Description of Artificial Sequence: Synthetic peptide"
ASTKGP

SEQ ID NO: 1154 - protein, 119 aa, Artificial Sequence; identical to SEQ ID NO: 944
  source: /note="Description of Artificial Sequence: Synthetic polypeptide"

SEQ ID NO: 1155 - protein, 330 aa, Artificial Sequence; identical to SEQ ID NO: 25
  source: /note="Description of Artificial Sequence: Synthetic polypeptide"

SEQ ID NO: 1156 - protein, 224 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 1157 - protein, 108 aa, Artificial Sequence; identical to SEQ ID NO: 387
  source: /note="Description of Artificial Sequence: Synthetic polypeptide"

SEQ ID NO: 1158 - protein, 5 aa, Artificial Sequence
  source: /note="Description of Artificial Sequence: Synthetic peptide"
TVAAP

SEQ ID NO: 1159 - protein, 111 aa, Artificial Sequence; identical to SEQ ID NO: 949
  source: /note="Description of Artificial Sequence: Synthetic polypeptide"

SEQ ID NO: 1160 - protein, 105 aa, Artificial Sequence; identical to SEQ ID NO: 30
  source: /note="Description of Artificial Sequence: Synthetic polypeptide"

SEQ ID NO: 1161 - protein, 253 aa, Artificial Sequence; identical to SEQ ID NO: 961
  source: /note="Description of Artificial Sequence: Synthetic polypeptide"

SEQ ID NO: 1162 - protein, 121 aa, Artificial Sequence [sequence omitted]

SEQ ID NO: 1163 - protein, 13 aa, Artificial Sequence
  source: /note="Description of Artificial Sequence: Synthetic peptide"
ASTKGPSVFPLAP

SEQ ID NO: 1164 - protein, 119 aa, Artificial Sequence; identical to SEQ ID NO: 944
  source: /note="Description of Artificial Sequence: Synthetic polypeptide"

SEQ ID NO: 1165 - protein, 330 aa, Artificial Sequence; identical to SEQ ID NO: 25
  source: /note="Description of Artificial Sequence: Synthetic polypeptide"

SEQ ID NO: 1166 - protein, 231 aa, Artificial Sequence
  source: /note="Description of Artificial Sequence: Synthetic polypeptide"
DIQMTQSPSSLSASVGDRVTITCRASQSIRNYLSWYQQKPGKAPKLLIYAASTLQSGVPSRFSGSGSGTDFTLTISSLQPEDVATYYCQRYNRAPYTFGQGTKVEIKRTVAAPSVFIFPPQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 1167 - protein, 108 aa, Artificial Sequence; identical to SEQ ID NO: 387
  source: /note="Description of Artificial Sequence: Synthetic polypeptide"

SEQ ID NO: 1168 - protein, 12 aa, Artificial Sequence
  source: /note="Description of Artificial Sequence: Synthetic peptide"
TVAAPSVFIFPP

SEQ ID NO: 1169 - protein, 111 aa, Artificial Sequence; identical to SEQ ID NO: 949
  source: /note="Description of Artificial Sequence: Synthetic polypeptide"

SEQ ID NO: 1170 - protein, 105 aa, Artificial Sequence; identical to SEQ ID NO: 30
  source: /note="Description of Artificial Sequence: Synthetic polypeptide"

SEQ ID NO: 1171 - protein, 246 aa, Artificial Sequence; identical to SEQ ID NO: 951
  source: /note="Description of Artificial Sequence: Synthetic polypeptide"

SEQ ID NO: 1172 - protein, 121 aa, Artificial Sequence [sequence omitted]

SEQ ID NO: 1173 - protein, 6 aa, Artificial Sequence
  source: /note="Description of Artificial Sequence: Synthetic peptide"
ASTKGP

SEQ ID NO: 1174 - protein, 119 aa, Artificial Sequence; identical to SEQ ID NO: 944
  source: /note="Description of Artificial Sequence: Synthetic polypeptide"

SEQ ID NO: 1175 - protein, 330 aa, Artificial Sequence; identical to SEQ ID NO: 25
  source: /note="Description of Artificial Sequence: Synthetic polypeptide"

SEQ ID NO: 1176 - protein, 231 aa, Artificial Sequence; identical to SEQ ID NO: 1166
  source: /note="Description of Artificial Sequence: Synthetic polypeptide"

SEQ ID NO: 1177 - protein, 108 aa, Artificial Sequence; identical to SEQ ID NO: 387
  source: /note="Description of Artificial Sequence: Synthetic polypeptide"

SEQ ID NO: 1178 - protein, 12 aa, Artificial Sequence
  source: /note="Description of Artificial Sequence: Synthetic peptide"
TVAAPSVFIFPP

SEQ ID NO: 1179 - protein, 111 aa, Artificial Sequence; identical to SEQ ID NO: 949
  source: /note="Description of Artificial Sequence: Synthetic polypeptide"

SEQ ID NO: 1180 - protein, 105 aa, Artificial Sequence; identical to SEQ ID NO: 30
  source: /note="Description of Artificial Sequence: Synthetic polypeptide"

SEQ ID NO: 1181 - protein, 253 aa, Artificial Sequence; identical to SEQ ID NO: 961
  source: /note="Description of Artificial Sequence: Synthetic polypeptide"

SEQ ID NO: 1182 - protein, 121 aa, Artificial Sequence [sequence omitted]

SEQ ID NO: 1183 - protein, 13 aa, Artificial Sequence
  source: /note="Description of Artificial Sequence: Synthetic peptide"
ASTKGPSVFPLAP

SEQ ID NO: 1184 - protein, 119 aa, Artificial Sequence; identical to SEQ ID NO: 944
  source: /note="Description of Artificial Sequence: Synthetic polypeptide"

SEQ ID NO: 1185 - protein, 330 aa, Artificial Sequence; identical to SEQ ID NO: 25
  source: /note="Description of Artificial Sequence: Synthetic polypeptide"

SEQ ID NO: 1186 - protein, 224 aa, Artificial Sequence; identical to SEQ ID NO: 1156
  source: /note="Description of Artificial Sequence: Synthetic polypeptide"

SEQ ID NO: 1187 - protein, 108 aa, Artificial Sequence; identical to SEQ ID NO: 387
  source: /note="Description of Artificial Sequence: Synthetic polypeptide"

SEQ ID NO: 1188 - protein, 5 aa, Artificial Sequence
  source: /note="Description of Artificial Sequence: Synthetic peptide"
TVAAP

SEQ ID NO: 1189 - protein, 111 aa, Artificial Sequence; identical to SEQ ID NO: 949
  source: /note="Description of Artificial Sequence: Synthetic polypeptide"

SEQ ID NO: 1190 - protein, 105 aa, Artificial Sequence; identical to SEQ ID NO: 30
  source: /note="Description of Artificial Sequence: Synthetic polypeptide"

SEQ ID NO: 1191 - protein, 246 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 1192 - protein, 117 aa, Artificial Sequence; identical to SEQ ID NO: 662
  source: /note="Description of Artificial Sequence: Synthetic polypeptide"

SEQ ID NO: 1193 - protein, 10 aa, Artificial Sequence
  source: /note="Description of Artificial Sequence: Synthetic peptide"
GGGGSGGGGS

SEQ ID NO: 1194 - protein, 119 aa, Artificial Sequence; identical to SEQ ID NO: 794
  source: /note="Description of Artificial Sequence: Synthetic polypeptide"

SEQ ID NO: 1195 - protein, 330 aa, Artificial Sequence; identical to SEQ ID NO: 25
  source: /note="Description of Artificial Sequence: Synthetic polypeptide"

SEQ ID NO: 1196 - protein, 228 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRGGSGGGGSGQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 1197 - protein, 108 aa, Artificial Sequence; identical to SEQ ID NO: 677
  source: /note="Description of Artificial Sequence: Synthetic polypeptide"

SEQ ID NO: 1198 - protein, 9 aa, Artificial Sequence
  source: /note="Description of Artificial Sequence: Synthetic peptide"
GGSGGGGSG

SEQ ID NO: 1199 - protein, 111 aa, Artificial Sequence; identical to SEQ ID NO: 799
  source: /note="Description of Artificial Sequence: Synthetic polypeptide"

SEQ ID NO: 1200 - protein, 105 aa, Artificial Sequence; identical to SEQ ID NO: 30
  source: /note="Description of Artificial Sequence: Synthetic polypeptide"

SEQ ID NO: 1201 - protein, 242 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSASTKGPEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 1202 - protein, 117 aa, Artificial Sequence; identical to SEQ ID NO: 662
  source: /note="Description of Artificial Sequence: Synthetic polypeptide"

SEQ ID NO: 1203 - protein, 6 aa, Artificial Sequence
  source: /note="Description of Artificial Sequence: Synthetic peptide"
ASTKGP

SEQ ID NO: 1204 - protein, 119 aa, Artificial Sequence; identical to SEQ ID NO: 794
  source: /note="Description of Artificial Sequence: Synthetic polypeptide"

SEQ ID NO: 1205 - protein, 330 aa, Artificial Sequence; identical to SEQ ID NO: 25
  source: /note="Description of Artificial Sequence: Synthetic polypeptide"

SEQ ID NO: 1206 - protein, 224 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 1207 - protein, 108 aa, Artificial Sequence; identical to SEQ ID NO: 677
  source: /note="Description of Artificial Sequence: Synthetic polypeptide"

SEQ ID NO: 1208 - protein, 5 aa, Artificial Sequence
  source: /note="Description of Artificial Sequence: Synthetic peptide"
TVAAP

SEQ ID NO: 1209 - protein, 111 aa, Artificial Sequence; identical to SEQ ID NO: 799
  source: /note="Description of Artificial Sequence: Synthetic polypeptide"

SEQ ID NO: 1210 - protein, 105 aa, Artificial Sequence; identical to SEQ ID NO: 30
  source: /note="Description of Artificial Sequence: Synthetic polypeptide"

SEQ ID NO: 1211 - protein, 249 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSASTKGPSVFPLAPEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 1212 - protein, 117 aa, Artificial Sequence; identical to SEQ ID NO: 662
  source: /note="Description of Artificial Sequence: Synthetic polypeptide"

SEQ ID NO: 1213 - protein, 13 aa, Artificial Sequence
  source: /note="Description of Artificial Sequence: Synthetic peptide"
ASTKGPSVFPLAP

SEQ ID NO: 1214 - protein, 119 aa, Artificial Sequence; identical to SEQ ID NO: 794
  source: /note="Description of Artificial Sequence: Synthetic polypeptide"

SEQ ID NO: 1215 - protein, 330 aa, Artificial Sequence; identical to SEQ ID NO: 25
  source: /note="Description of Artificial Sequence: Synthetic polypeptide"

SEQ ID NO: 1216 - protein, 231 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPSVFIFPPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 1217 - protein, 108 aa, Artificial Sequence; identical to SEQ ID NO: 677
  source: /note="Description of Artificial Sequence: Synthetic polypeptide"

SEQ ID NO: 1218 - protein, 12 aa, Artificial Sequence
  source: /note="Description of Artificial Sequence: Synthetic peptide"
TVAAPSVFIFPP

SEQ ID NO: 1219 - protein, 111 aa, Artificial Sequence; identical to SEQ ID NO: 799
  source: /note="Description of Artificial Sequence: Synthetic polypeptide"

SEQ ID NO: 1220 - protein, 105 aa, Artificial Sequence; identical to SEQ ID NO: 30
  source: /note="Description of Artificial Sequence: Synthetic polypeptide"

SEQ ID NO: 1221 - protein, 242 aa, Artificial Sequence; identical to SEQ ID NO: 1201
  source: /note="Description of Artificial Sequence: Synthetic polypeptide"

SEQ ID NO: 1222 - protein, 117 aa, Artificial Sequence; identical to SEQ ID NO: 662
  source: /note="Description of Artificial Sequence: Synthetic polypeptide"

SEQ ID NO: 1223 - protein, 6 aa, Artificial Sequence
  source: /note="Description of Artificial Sequence: Synthetic peptide"
ASTKGP

SEQ ID NO: 1224 - protein, 119 aa, Artificial Sequence; identical to SEQ ID NO: 794
  source: /note="Description of Artificial Sequence: Synthetic polypeptide"

SEQ ID NO: 1225 - protein, 330 aa, Artificial Sequence; identical to SEQ ID NO: 25
  source: /note="Description of Artificial Sequence: Synthetic polypeptide"

SEQ ID NO: 1226 - protein, 231 aa, Artificial Sequence; identical to SEQ ID NO: 1216
  source: /note="Description of Artificial Sequence: Synthetic polypeptide"

SEQ ID NO: 1227 - protein, 108 aa, Artificial Sequence; identical to SEQ ID NO: 677
  source: /note="Description of Artificial Sequence: Synthetic polypeptide"

SEQ ID NO: 1228 - protein, 12 aa, Artificial Sequence
  source: /note="Description of Artificial Sequence: Synthetic peptide"
TVAAPSVFIFPP

SEQ ID NO: 1229 - protein, 111 aa, Artificial Sequence; identical to SEQ ID NO: 799
  source: /note="Description of Artificial Sequence: Synthetic polypeptide"

SEQ ID NO: 1230 - protein, 105 aa, Artificial Sequence; identical to SEQ ID NO: 30
  source: /note="Description of Artificial Sequence: Synthetic polypeptide"

SEQ ID NO: 1231 - protein, 249 aa, Artificial Sequence; identical to SEQ ID NO: 1211
  source: /note="Description of Artificial Sequence: Synthetic polypeptide"

SEQ ID NO: 1232 - protein, 117 aa, Artificial Sequence; identical to SEQ ID NO: 662
  source: /note="Description of Artificial Sequence: Synthetic polypeptide"

SEQ ID NO: 1233 - protein, 13 aa, Artificial Sequence
  source: /note="Description of Artificial Sequence: Synthetic peptide"
ASTKGPSVFPLAP

SEQ ID NO: 1234 - protein, 119 aa, Artificial Sequence; identical to SEQ ID NO: 794
  source: /note="Description of Artificial Sequence: Synthetic polypeptide"

SEQ ID NO: 1235 - protein, 330 aa, Artificial Sequence; identical to SEQ ID NO: 25
  source: /note="Description of Artificial Sequence: Synthetic polypeptide"

SEQ ID NO: 1236 - protein, 224 aa, Artificial Sequence; identical to SEQ ID NO: 1206
  source: /note="Description of Artificial Sequence: Synthetic polypeptide"

SEQ ID NO: 1237 - protein, 108 aa, Artificial Sequence; identical to SEQ ID NO: 677
  source: /note="Description of Artificial Sequence: Synthetic polypeptide"

SEQ ID NO: 1238 - protein, 5 aa, Artificial Sequence
  source: /note="Description of Artificial Sequence: Synthetic peptide"
TVAAP

SEQ ID NO: 1239 - protein, 111 aa, Artificial Sequence; identical to SEQ ID NO: 799
  source: /note="Description of Artificial Sequence: Synthetic polypeptide"

SEQ ID NO: 1240 - protein, 105 aa, Artificial Sequence; identical to SEQ ID NO: 30
  source: /note="Description of Artificial Sequence: Synthetic polypeptide"

SEQ ID NO: 1241 - protein, 246 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 1242 - protein, 117 aa, Artificial Sequence; identical to SEQ ID NO: 662
  source: /note="Description of Artificial Sequence: Synthetic polypeptide"

SEQ ID NO: 1243 - protein, 10 aa, Artificial Sequence
  source: /note="Description of Artificial Sequence: Synthetic peptide"
GGGGSGGGGS

SEQ ID NO: 1244 - protein, 119 aa, Artificial Sequence; identical to SEQ ID NO: 844
  source: /note="Description of Artificial Sequence: Synthetic polypeptide"

SEQ ID NO: 1245 - protein, 330 aa, Artificial Sequence; identical to SEQ ID NO: 25
  source: /note="Description of Artificial Sequence: Synthetic polypeptide"

SEQ ID NO: 1246 - protein, 229 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRGGSGGGGSGQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 1247 - protein, 108 aa, Artificial Sequence; identical to SEQ ID NO: 677
  source: /note="Description of Artificial Sequence: Synthetic polypeptide"

SEQ ID NO: 1248 - protein, 9 aa, Artificial Sequence
  source: /note="Description of Artificial Sequence: Synthetic peptide"
GGSGGGGSG

SEQ ID NO: 1249 - protein, 112 aa, Artificial Sequence; identical to SEQ ID NO: 849
  source: /note="Description of Artificial Sequence: Synthetic polypeptide"

SEQ ID NO: 1250 - protein, 105 aa, Artificial Sequence; identical to SEQ ID NO: 30
  source: /note="Description of Artificial Sequence: Synthetic polypeptide"

SEQ ID NO: 1251 - protein, 242 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSASTKGPEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 1252 - protein, 117 aa, Artificial Sequence; identical to SEQ ID NO: 662
  source: /note="Description of Artificial Sequence: Synthetic polypeptide"

SEQ ID NO: 1253 - protein, 6 aa, Artificial Sequence
  source: /note="Description of Artificial Sequence: Synthetic peptide"
ASTKGP

SEQ ID NO: 1254 - protein, 119 aa, Artificial Sequence; identical to SEQ ID NO: 844
  source: /note="Description of Artificial Sequence: Synthetic polypeptide"

SEQ ID NO: 1255 - protein, 330 aa, Artificial Sequence; identical to SEQ ID NO: 25
  source: /note="Description of Artificial Sequence: Synthetic polypeptide"

SEQ ID NO: 1256 - protein, 225 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 1257 - protein, 108 aa, Artificial Sequence; identical to SEQ ID NO: 677
  source: /note="Description of Artificial Sequence: Synthetic polypeptide"

SEQ ID NO: 1258 - protein, 5 aa, Artificial Sequence
  source: /note="Description of Artificial Sequence: Synthetic peptide"
TVAAP

SEQ ID NO: 1259 - protein, 112 aa, Artificial Sequence; identical to SEQ ID NO: 849
  source: /note="Description of Artificial Sequence: Synthetic polypeptide"

SEQ ID NO: 1260 - protein, 105 aa, Artificial Sequence; identical to SEQ ID NO: 30
  source: /note="Description of Artificial Sequence: Synthetic polypeptide"

SEQ ID NO: 1261 - protein, 249 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSASTKGPSVFPLAPEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 1262 - protein, 117 aa, Artificial Sequence; identical to SEQ ID NO: 662
  source: /note="Description of Artificial Sequence: Synthetic polypeptide"

SEQ ID NO: 1263 - protein, 13 aa, Artificial Sequence
  source: /note="Description of Artificial Sequence: Synthetic peptide"
ASTKGPSVFPLAP

SEQ ID NO: 1264 - protein, 119 aa, Artificial Sequence; identical to SEQ ID NO: 844
  source: /note="Description of Artificial Sequence: Synthetic polypeptide"

SEQ ID NO: 1265 - protein, 330 aa, Artificial Sequence; identical to SEQ ID NO: 25
  source: /note="Description of Artificial Sequence: Synthetic polypeptide"

SEQ ID NO: 1266 - protein, 232 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPSVFIFPPQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 1267 - protein, 108 aa, Artificial Sequence; identical to SEQ ID NO: 677
  source: /note="Description of Artificial Sequence: Synthetic polypeptide"

SEQ ID NO: 1268 - protein, 12 aa, Artificial Sequence
  source: /note="Description of Artificial Sequence: Synthetic peptide"
TVAAPSVFIFPP

SEQ ID NO: 1269 - protein, 112 aa, Artificial Sequence; identical to SEQ ID NO: 849
  source: /note="Description of Artificial Sequence: Synthetic polypeptide"

SEQ ID NO: 1270 - protein, 105 aa, Artificial Sequence; identical to SEQ ID NO: 30
  source: /note="Description of Artificial Sequence: Synthetic polypeptide"

SEQ ID NO: 1271 - protein, 242 aa, Artificial Sequence; identical to SEQ ID NO: 1251
  source: /note="Description of Artificial Sequence: Synthetic polypeptide"

SEQ ID NO: 1272 - protein, 117 aa, Artificial Sequence; identical to SEQ ID NO: 662
  source: /note="Description of Artificial Sequence: Synthetic polypeptide"

SEQ ID NO: 1273 - protein, 6 aa, Artificial Sequence
  source: /note="Description of Artificial Sequence: Synthetic peptide"
ASTKGP

SEQ ID NO: 1274 - protein, 119 aa, Artificial Sequence; identical to SEQ ID NO: 844
  source: /note="Description of Artificial Sequence: Synthetic polypeptide"

SEQ ID NO: 1275 - protein, 330 aa, Artificial Sequence; identical to SEQ ID NO: 25
  source: /note="Description of Artificial Sequence: Synthetic polypeptide"

SEQ ID NO: 1276 - protein, 232 aa, Artificial Sequence; identical to SEQ ID NO: 1266
  source: /note="Description of Artificial Sequence: Synthetic polypeptide"

SEQ ID NO: 1277 - protein, 108 aa, Artificial Sequence; identical to SEQ ID NO: 677
  source: /note="Description of Artificial Sequence: Synthetic polypeptide"

SEQ ID NO: 1278 - protein, 12 aa, Artificial Sequence
  source: /note="Description of Artificial Sequence: Synthetic peptide"
TVAAPSVFIFPP

SEQ ID NO: 1279 - protein, 112 aa, Artificial Sequence; identical to SEQ ID NO: 849
  source: /note="Description of Artificial Sequence: Synthetic polypeptide"

SEQ ID NO: 1280 - protein, 105 aa, Artificial Sequence; identical to SEQ ID NO: 30
  source: /note="Description of Artificial Sequence: Synthetic polypeptide"

SEQ ID NO: 1281 - protein, 249 aa, Artificial Sequence; identical to SEQ ID NO: 1261
  source: /note="Description of Artificial Sequence: Synthetic polypeptide"

SEQ ID NO: 1282 - protein, 117 aa, Artificial Sequence; identical to SEQ ID NO: 662
  source: /note="Description of Artificial Sequence: Synthetic polypeptide"

SEQ ID NO: 1283 - protein, 13 aa, Artificial Sequence
  source: /note="Description of Artificial Sequence: Synthetic peptide"
ASTKGPSVFPLAP

SEQ ID NO: 1284 - protein, 119 aa, Artificial Sequence; identical to SEQ ID NO: 844
  source: /note="Description of Artificial Sequence: Synthetic polypeptide"

SEQ ID NO: 1285 - protein, 330 aa, Artificial Sequence; identical to SEQ ID NO: 25
  source: /note="Description of Artificial Sequence: Synthetic polypeptide"

SEQ ID NO: 1286 - protein, 225 aa, Artificial Sequence; identical to SEQ ID NO: 1256
  source: /note="Description of Artificial Sequence: Synthetic polypeptide"

SEQ ID NO: 1287 - protein, 108 aa, Artificial Sequence; identical to SEQ ID NO: 677
  source: /note="Description of Artificial Sequence: Synthetic polypeptide"

SEQ ID NO: 1288 - protein, 5 aa, Artificial Sequence
  source: /note="Description of Artificial Sequence: Synthetic peptide"
TVAAP

SEQ ID NO: 1289 - protein, 112 aa, Artificial Sequence; identical to SEQ ID NO: 849
  source: /note="Description of Artificial Sequence: Synthetic polypeptide"

SEQ ID NO: 1290 - protein, 330 aa, Artificial Sequence; identical to SEQ ID NO: 25
  source: /note="Description of Artificial Sequence: Synthetic polypeptide"

SEQ ID NO: 1291 - protein, 246 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 1292 - protein, 117 aa, Artificial Sequence; identical to SEQ ID NO: 662
  source: /note="Description of Artificial Sequence: Synthetic polypeptide"

SEQ ID NO: 1293 - protein, 10 aa, Artificial Sequence
  source: /note="Description of Artificial Sequence: Synthetic peptide"
GGGGSGGGGS

SEQ ID NO: 1294 - protein, 119 aa, Artificial Sequence; identical to SEQ ID NO: 894
  source: /note="Description of Artificial Sequence: Synthetic polypeptide"

SEQ ID NO: 1295 - protein, 330 aa, Artificial Sequence; identical to SEQ ID NO: 25
  source: /note="Description of Artificial Sequence: Synthetic polypeptide"

SEQ ID NO: 1296 - protein, 229 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRGGSGGGGSGQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 1297 - protein, 108 aa, Artificial Sequence; identical to SEQ ID NO: 677
  source: /note="Description of Artificial Sequence: Synthetic polypeptide"

SEQ ID NO: 1298 - protein, 9 aa, Artificial Sequence
  source: /note="Description of Artificial Sequence: Synthetic peptide"
GGSGGGGSG

SEQ ID NO: 1299 - protein, 112 aa, Artificial Sequence; identical to SEQ ID NO: 899
  source: /note="Description of Artificial Sequence: Synthetic polypeptide"

SEQ ID NO: 1300 - protein, 105 aa, Artificial Sequence; identical to SEQ ID NO: 30
  source: /note="Description of Artificial Sequence: Synthetic polypeptide"

SEQ ID NO: 1301 - protein, 242 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSASTKGPEVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 1302 - protein, 117 aa, Artificial Sequence; identical to SEQ ID NO: 662
  source: /note="Description of Artificial Sequence: Synthetic polypeptide"

SEQ ID NO: 1303 - protein, 6 aa, Artificial Sequence
  source: /note="Description of Artificial Sequence: Synthetic peptide"
ASTKGP

SEQ ID NO: 1304 - protein, 119 aa, Artificial Sequence; identical to SEQ ID NO: 894
  source: /note="Description of Artificial Sequence: Synthetic polypeptide"

SEQ ID NO: 1305 - protein, 330 aa, Artificial Sequence; identical to SEQ ID NO: 25
  source: /note="Description of Artificial Sequence: Synthetic polypeptide"

SEQ ID NO: 1306 - protein, 225 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 1307 - protein, 108 aa, Artificial Sequence; identical to SEQ ID NO: 677
  source: /note="Description of Artificial Sequence: Synthetic polypeptide"

SEQ ID NO: 1308 - protein, 5 aa, Artificial Sequence
  source: /note="Description of Artificial Sequence: Synthetic peptide"
TVAAP

SEQ ID NO: 1309 - protein, 112 aa, Artificial Sequence; identical to SEQ ID NO: 899
  source: /note="Description of Artificial Sequence: Synthetic polypeptide"

SEQ ID NO: 1310 - protein, 105 aa, Artificial Sequence; identical to SEQ ID NO: 30
  source: /note="Description of Artificial Sequence: Synthetic polypeptide"

SEQ ID NO: 1311 - protein, 249 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSASTKGPSVFPLAPEVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 1312 - protein, 117 aa, Artificial Sequence; identical to SEQ ID NO: 662
  source: /note="Description of Artificial Sequence: Synthetic polypeptide"

SEQ ID NO: 1313 - protein, 13 aa, Artificial Sequence
  source: /note="Description of Artificial Sequence: Synthetic peptide"
ASTKGPSVFPLAP

SEQ ID NO: 1314 - protein, 119 aa, Artificial Sequence; identical to SEQ ID NO: 894
  source: /note="Description of Artificial Sequence: Synthetic polypeptide"

SEQ ID NO: 1315 - protein, 330 aa, Artificial Sequence; identical to SEQ ID NO: 25
  source: /note="Description of Artificial Sequence: Synthetic polypeptide"

SEQ ID NO: 1316 - protein, 232 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPSVFIFPPQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 1317 - protein, 108 aa, Artificial Sequence; identical to SEQ ID NO: 677
  source: /note="Description of Artificial Sequence: Synthetic polypeptide"

SEQ ID NO: 1318 - protein, 12 aa, Artificial Sequence
  source: /note="Description of Artificial Sequence: Synthetic peptide"
TVAAPSVFIFPP

SEQ ID NO: 1319 - protein, 112 aa, Artificial Sequence; identical to SEQ ID NO: 899
  source: /note="Description of Artificial Sequence: Synthetic polypeptide"

SEQ ID NO: 1320 - protein, 105 aa, Artificial Sequence; identical to SEQ ID NO: 30
  source: /note="Description of Artificial Sequence: Synthetic polypeptide"

SEQ ID NO: 1321 - protein, 242 aa, Artificial Sequence; identical to SEQ ID NO: 1301
  source: /note="Description of Artificial Sequence: Synthetic polypeptide"

SEQ ID NO: 1322 - protein, 117 aa, Artificial Sequence; identical to SEQ ID NO: 662
  source: /note="Description of Artificial Sequence: Synthetic polypeptide"

SEQ ID NO: 1323 - protein, 6 aa, Artificial Sequence
  source: /note="Description of Artificial Sequence: Synthetic peptide"
ASTKGP

SEQ ID NO: 1324 - protein, 119 aa, Artificial Sequence; identical to SEQ ID NO: 894
  source: /note="Description of Artificial Sequence: Synthetic polypeptide"

SEQ ID NO: 1325 - protein, 330 aa, Artificial Sequence; identical to SEQ ID NO: 25
  source: /note="Description of Artificial Sequence: Synthetic polypeptide"

SEQ ID NO: 1326 - protein, 232 aa, Artificial Sequence; identical to SEQ ID NO: 1316
  source: /note="Description of Artificial Sequence: Synthetic polypeptide"

SEQ ID NO: 1327 - protein, 108 aa, Artificial Sequence; identical to SEQ ID NO: 677
  source: /note="Description of Artificial Sequence: Synthetic polypeptide"

SEQ ID NO: 1328 - protein, 12 aa, Artificial Sequence
  source: /note="Description of Artificial Sequence: Synthetic peptide"
TVAAPSVFIFPP

SEQ ID NO: 1329 - protein, 112 aa, Artificial Sequence; identical to SEQ ID NO: 899
  source: /note="Description of Artificial Sequence: Synthetic polypeptide"

SEQ ID NO: 1330 - protein, 105 aa, Artificial Sequence; identical to SEQ ID NO: 30
  source: /note="Description of Artificial Sequence: Synthetic polypeptide"

SEQ ID NO: 1331 - protein, 249 aa, Artificial Sequence; identical to SEQ ID NO: 1311
  source: /note="Description of Artificial Sequence: Synthetic polypeptide"

SEQ ID NO: 1332 - protein, 117 aa, Artificial Sequence; identical to SEQ ID NO: 662
  source: /note="Description of Artificial Sequence: Synthetic polypeptide"

SEQ ID NO: 1333 - protein, 13 aa, Artificial Sequence
  source: /note="Description of Artificial Sequence: Synthetic peptide"
ASTKGPSVFPLAP

SEQ ID NO: 1334 - protein, 119 aa, Artificial Sequence; identical to SEQ ID NO: 894
  source: /note="Description of Artificial Sequence: Synthetic polypeptide"

SEQ ID NO: 1335 - protein, 330 aa, Artificial Sequence; identical to SEQ ID NO: 25
  source: /note="Description of Artificial Sequence: Synthetic polypeptide"

SEQ ID NO: 1336 - protein, 225 aa, Artificial Sequence; identical to SEQ ID NO: 1306
  source: /note="Description of Artificial Sequence: Synthetic polypeptide"

SEQ ID NO: 1337 - protein, 108 aa, Artificial Sequence; identical to SEQ ID NO: 677
  source: /note="Description of Artificial Sequence: Synthetic polypeptide"

SEQ ID NO: 1338 - protein, 5 aa, Artificial Sequence
  source: /note="Description of Artificial Sequence: Synthetic peptide"
TVAAP

SEQ ID NO: 1339 - protein, 112 aa, Artificial Sequence; identical to SEQ ID NO: 899
  source: /note="Description of Artificial Sequence: Synthetic polypeptide"

SEQ ID NO: 1340 - protein, 105 aa, Artificial Sequence; identical to SEQ ID NO: 30
  source: /note="Description of Artificial Sequence: Synthetic polypeptide"

SEQ ID NO: 1341 - protein, 246 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 1342 - protein, 117 aa, Artificial Sequence; identical to SEQ ID NO: 662
  source: /note="Description of Artificial Sequence: Synthetic polypeptide"

SEQ ID NO: 1343 - protein, 10 aa, Artificial Sequence
  source: /note="Description of Artificial Sequence: Synthetic peptide"
GGGGSGGGGS

SEQ ID NO: 1344 - protein, 119 aa, Artificial Sequence; identical to SEQ ID NO: 944
  source: /note="Description of Artificial Sequence: Synthetic polypeptide"

SEQ ID NO: 1345 - protein, 330 aa, Artificial Sequence; identical to SEQ ID NO: 25
  source: /note="Description of Artificial Sequence: Synthetic polypeptide"

SEQ ID NO: 1346 - protein, 228 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRGGSGGGGSGQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 1347 - protein, 108 aa, Artificial Sequence; identical to SEQ ID NO: 677
  source: /note="Description of Artificial Sequence: Synthetic polypeptide"

SEQ ID NO: 1348 - protein, 9 aa, Artificial Sequence
  source: /note="Description of Artificial Sequence: Synthetic peptide"
GGSGGGGSG

SEQ ID NO: 1349 - protein, 111 aa, Artificial Sequence; identical to SEQ ID NO: 949
  source: /note="Description of Artificial Sequence: Synthetic polypeptide"

SEQ ID NO: 1350 - protein, 105 aa, Artificial Sequence; identical to SEQ ID NO: 30
  source: /note="Description of Artificial Sequence: Synthetic polypeptide"

SEQ ID NO: 1351 - protein, 242 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSASTKGPEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 1352 - protein, 117 aa, Artificial Sequence; identical to SEQ ID NO: 662
  source: /note="Description of Artificial Sequence: Synthetic polypeptide"

SEQ ID NO: 1353 - protein, 6 aa, Artificial Sequence
  source: /note="Description of Artificial Sequence: Synthetic peptide"
ASTKGP

SEQ ID NO: 1354 - protein, 119 aa, Artificial Sequence; identical to SEQ ID NO: 944
  source: /note="Description of Artificial Sequence: Synthetic polypeptide"

SEQ ID NO: 1355 - protein, 330 aa, Artificial Sequence; identical to SEQ ID NO: 25
  source: /note="Description of Artificial Sequence: Synthetic polypeptide"

SEQ ID NO: 1356 - protein, 224 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 1357 - protein, 108 aa, Artificial Sequence; identical to SEQ ID NO: 677
  source: /note="Description of Artificial Sequence: Synthetic polypeptide"

SEQ ID NO: 1358 - protein, 5 aa, Artificial Sequence
  source: /note="Description of Artificial Sequence: Synthetic peptide"
TVAAP

SEQ ID NO: 1359 - protein, 111 aa, Artificial Sequence; identical to SEQ ID NO: 949
  source: /note="Description of Artificial Sequence: Synthetic polypeptide"

SEQ ID NO: 1360 - protein, 105 aa, Artificial Sequence; identical to SEQ ID NO: 30
  source: /note="Description of Artificial Sequence: Synthetic polypeptide"

SEQ ID NO: 1361 - protein, 249 aa, Artificial Sequence
  source: /note="Description of Artificial Sequence: Synthetic polypeptide"
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSASTKGPSVFPLAPEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 1362 - protein, 117 aa, Artificial Sequence; identical to SEQ ID NO: 662
  source: /note="Description of Artificial Sequence: Synthetic polypeptide"

SEQ ID NO: 1363 - protein, 13 aa, Artificial Sequence
  source: /note="Description of Artificial Sequence: Synthetic peptide"
ASTKGPSVFPLAP

SEQ ID NO: 1364 - protein, 119 aa, Artificial Sequence; identical to SEQ ID NO: 944
  source: /note="Description of Artificial Sequence: Synthetic polypeptide"

SEQ ID NO: 1365 - protein, 330 aa, Artificial Sequence; identical to SEQ ID NO: 25
  source: /note="Description of Artificial Sequence: Synthetic polypeptide"

SEQ ID NO: 1366 - protein, 231 aa, Artificial Sequence
  source: /note="Description of Artificial Sequence: Synthetic polypeptide"
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRTVAAPSVFIFPPQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 1367 - protein, 108 aa, Artificial Sequence; identical to SEQ ID NO: 677
  source: /note="Description of Artificial Sequence: Synthetic polypeptide"

SEQ ID NO: 1368 - protein, 12 aa, Artificial Sequence
  source: /note="Description of Artificial Sequence: Synthetic peptide"
TVAAPSVFIFPP

SEQ ID NO: 1369 - protein, 111 aa, Artificial Sequence; identical to SEQ ID NO: 949
  source: /note="Description of Artificial Sequence: Synthetic polypeptide"

SEQ ID NO: 1370 - protein, 105 aa, Artificial Sequence; identical to SEQ ID NO: 30
  source: /note="Description of Artificial Sequence: Synthetic polypeptide"

SEQ ID NO: 1371 - protein, 242 aa, Artificial Sequence; identical to SEQ ID NO: 1351
  source: /note="Description of Artificial Sequence: Synthetic polypeptide"

SEQ ID NO: 1372 - protein, 117 aa, Artificial Sequence; identical to SEQ ID NO: 662
  source: /note="Description of Artificial Sequence: Synthetic polypeptide"

SEQ ID NO: 1373 - protein, 6 aa, Artificial Sequence
  source: /note="Description of Artificial Sequence: Synthetic peptide"
ASTKGP

SEQ ID NO: 1374 - protein, 119 aa, Artificial Sequence; identical to SEQ ID NO: 944
  source: /note="Description of Artificial Sequence: Synthetic polypeptide"

SEQ ID NO: 1375 - protein, 330 aa, Artificial Sequence; identical to SEQ ID NO: 25
  source: /note="Description of Artificial Sequence: Synthetic polypeptide"

SEQ ID NO: 1376 - protein, 231 aa, Artificial Sequence; identical to SEQ ID NO: 1366
  source: /note="Description of Artificial Sequence: Synthetic polypeptide"

SEQ ID NO: 1377 - protein, 108 aa, Artificial Sequence; identical to SEQ ID NO: 677
  source: /note="Description of Artificial Sequence: Synthetic polypeptide"

SEQ ID NO: 1378 - protein, 12 aa, Artificial Sequence
  source: /note="Description of Artificial Sequence: Synthetic peptide"
TVAAPSVFIFPP

SEQ ID NO: 1379 - protein, 111 aa, Artificial Sequence; identical to SEQ ID NO: 949
  source: /note="Description of Artificial Sequence: Synthetic polypeptide"

SEQ ID NO: 1380 - protein, 105 aa, Artificial Sequence; identical to SEQ ID NO: 30
  source: /note="Description of Artificial Sequence: Synthetic polypeptide"

SEQ ID NO: 1381 - protein, 249 aa, Artificial Sequence; identical to SEQ ID NO: 1361
  source: /note="Description of Artificial Sequence: Synthetic polypeptide"

SEQ ID NO: 1382 - protein, 117 aa, Artificial Sequence; identical to SEQ ID NO: 662
  source: /note="Description of Artificial Sequence: Synthetic polypeptide"

SEQ ID NO: 1383 - protein, 13 aa, Artificial Sequence
  source: /note="Description of Artificial Sequence: Synthetic peptide"
ASTKGPSVFPLAP

SEQ ID NO: 1384 - protein, 119 aa, Artificial Sequence; identical to SEQ ID NO: 944
  source: /note="Description of Artificial Sequence: Synthetic polypeptide"

SEQ ID NO: 1385 - protein, 330 aa, Artificial Sequence; identical to SEQ ID NO: 25
  source: /note="Description of Artificial Sequence: Synthetic polypeptide"

SEQ ID NO: 1386 - protein, 224 aa, Artificial Sequence; identical to SEQ ID NO: 1356
  source: /note="Description of Artificial Sequence: Synthetic polypeptide"

SEQ ID NO: 1387 - protein, 108 aa, Artificial Sequence; identical to SEQ ID NO: 677
  source: /note="Description of Artificial Sequence: Synthetic polypeptide"

SEQ ID NO: 1388 - protein, 5 aa, Artificial Sequence
  source: /note="Description of Artificial Sequence: Synthetic peptide"
TVAAP

SEQ ID NO: 1389 - protein, 111 aa, Artificial Sequence; identical to SEQ ID NO: 949
  source: /note="Description of Artificial Sequence: Synthetic polypeptide"

SEQ ID NO: 1390 - protein, 105 aa, Artificial Sequence; identical to SEQ ID NO: 30
  source: /note="Description of Artificial Sequence: Synthetic polypeptide"

SEQ ID NO: 1391 - protein, 246 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 1392 - protein, 117 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS

SEQ ID NO: 1393 - protein, 10 aa, Artificial Sequence
  source: /note="Description of Artificial Sequence: Synthetic peptide"
GGGGSGGGGS

SEQ ID NO: 1394 - protein, 119 aa, Artificial Sequence; identical to SEQ ID NO: 794
  source: /note="Description of Artificial Sequence: Synthetic polypeptide"

SEQ ID NO: 1395 - protein, 330 aa, Artificial Sequence; identical to SEQ ID NO: 25
  source: /note="Description of Artificial Sequence: Synthetic polypeptide"

SEQ ID NO: 1396 - protein, 228 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRGGSGGGGSGQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 1397 - protein, 108 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKR

SEQ ID NO: 1398 - protein, 9 aa, Artificial Sequence
  source: /note="Description of Artificial Sequence: Synthetic peptide"
GGSGGGGSG

SEQ ID NO: 1399 - protein, 111 aa, Artificial Sequence; identical to SEQ ID NO: 799
  source: /note="Description of Artificial Sequence: Synthetic polypeptide"

SEQ ID NO: 1400 - protein, 105 aa, Artificial Sequence; identical to SEQ ID NO: 30
  source: /note="Description of Artificial Sequence: Synthetic polypeptide"

SEQ ID NO: 1401 - protein, 242 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 1402 - protein, 117 aa, Artificial Sequence; identical to SEQ ID NO: 1392
  source: /note="Description of Artificial Sequence: Synthetic polypeptide"

SEQ ID NO: 1403 - protein, 6 aa, Artificial Sequence
  source: /note="Description of Artificial Sequence: Synthetic peptide"
ASTKGP

SEQ ID NO: 1404 - protein, 119 aa, Artificial Sequence; identical to SEQ ID NO: 794
  source: /note="Description of Artificial Sequence: Synthetic polypeptide"

SEQ ID NO: 1405 - protein, 330 aa, Artificial Sequence; identical to SEQ ID NO: 25
  source: /note="Description of Artificial Sequence: Synthetic polypeptide"

SEQ ID NO: 1406 - protein, 224 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 1407 - protein, 108 aa, Artificial Sequence; identical to SEQ ID NO: 1397
  source: /note="Description of Artificial Sequence: Synthetic polypeptide"

SEQ ID NO: 1408 - protein, 5 aa, Artificial Sequence
  source: /note="Description of Artificial Sequence: Synthetic peptide"
TVAAP

SEQ ID NO: 1409 - protein, 111 aa, Artificial Sequence; identical to SEQ ID NO: 799
  source: /note="Description of Artificial Sequence: Synthetic polypeptide"

SEQ ID NO: 1410 - protein, 105 aa, Artificial Sequence; identical to SEQ ID NO: 30
  source: /note="Description of Artificial Sequence: Synthetic polypeptide"

SEQ ID NO: 1411 - protein, 249 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPSVFPLAPEVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSS

SEQ ID NO: 1412 - protein, 117 aa, Artificial Sequence; identical to SEQ ID NO: 1392
  source: /note="Description of Artificial Sequence: Synthetic polypeptide"

SEQ ID NO: 1413 - protein, 13 aa, Artificial Sequence
  source: /note="Description of Artificial Sequence: Synthetic peptide"
ASTKGPSVFPLAP

SEQ ID NO: 1414 - protein, 119 aa, Artificial Sequence; identical to SEQ ID NO: 794
  source: /note="Description of Artificial Sequence: Synthetic polypeptide"

SEQ ID NO: 1415 - protein, 330 aa, Artificial Sequence; identical to SEQ ID NO: 25
  source: /note="Description of Artificial Sequence: Synthetic polypeptide"

SEQ ID NO: 1416 - protein, 231 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPSVFIFPPQSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLG

SEQ ID NO: 1417 - protein, 108 aa, Artificial Sequence; identical to SEQ ID NO: 1397
  source: /note="Description of Artificial Sequence: Synthetic polypeptide"

SEQ ID NO: 1418 - protein, 12 aa, Artificial Sequence
  source: /note="Description of Artificial Sequence: Synthetic peptide"
TVAAPSVFIFPP

SEQ ID NO: 1419 - protein, 111 aa, Artificial Sequence; identical to SEQ ID NO: 799
  source: /note="Description of Artificial Sequence: Synthetic polypeptide"

SEQ ID NO: 1420 - protein, 105 aa, Artificial Sequence; identical to SEQ ID NO: 30
  source: /note="Description of Artificial Sequence: Synthetic polypeptide"

SEQ ID NO: 1421 - protein, 242 aa, Artificial Sequence; identical to SEQ ID NO: 1401
  source: /note="Description of Artificial Sequence: Synthetic polypeptide"

SEQ ID NO: 1422 - protein, 117 aa, Artificial Sequence; identical to SEQ ID NO: 1392
  source: /note="Description of Artificial Sequence: Synthetic polypeptide"

SEQ ID NO: 1423 - protein, 6 aa, Artificial Sequence
  source: /note="Description of Artificial Sequence: Synthetic peptide"
ASTKGP

SEQ ID NO: 1424 - protein, 119 aa, Artificial Sequence; identical to SEQ ID NO: 794
  source: /note="Description of Artificial Sequence: Synthetic polypeptide"

SEQ ID NO: 1425 - protein, 330 aa, Artificial Sequence; identical to SEQ ID NO: 25
  source: /note="Description of Artificial Sequence: Synthetic polypeptide"

SEQ ID NO: 1426 - protein, 231 aa, Artificial Sequence; identical to SEQ ID NO: 1416
  source: /note="Description of Artificial Sequence: Synthetic polypeptide"

SEQ ID NO: 1427 - protein, 108 aa, Artificial Sequence; identical to SEQ ID NO: 1397
  source: /note="Description of Artificial Sequence: Synthetic polypeptide"

SEQ ID NO: 1428 - protein, 12 aa, Artificial Sequence
  source: /note="Description of Artificial Sequence: Synthetic peptide"
TVAAPSVFIFPP

SEQ ID NO: 1429 - protein, 111 aa, Artificial Sequence; identical to SEQ ID NO: 799
  source: /note="Description of Artificial Sequence: Synthetic polypeptide"

SEQ ID NO: 1430 - protein, 105 aa, Artificial Sequence; identical to SEQ ID NO: 30
  source: /note="Description of Artificial Sequence: Synthetic polypeptide"

SEQ ID NO: 1431 - protein, 249 aa, Artificial Sequence; identical to SEQ ID NO: 1411
  source: /note="Description of Artificial Sequence: Synthetic polypeptide"

SEQ ID NO: 1432 - protein, 117 aa, Artificial Sequence; identical to SEQ ID NO: 1392
  source: /note="Description of Artificial Sequence: Synthetic polypeptide"

SEQ ID NO: 1433 - protein, 13 aa, Artificial Sequence
  source: /note="Description of Artificial Sequence: Synthetic peptide"
ASTKGPSVFPLAP

SEQ ID NO: 1434 - protein, 119 aa, Artificial Sequence; identical to SEQ ID NO: 794
  source: /note="Description of Artificial Sequence: Synthetic polypeptide"

SEQ ID NO: 1435 - protein, 330 aa, Artificial Sequence; identical to SEQ ID NO: 25
  source: /note="Description of Artificial Sequence: Synthetic polypeptide"

SEQ ID NO: 1436 - protein, 224 aa, Artificial Sequence; identical to SEQ ID NO: 1406
  source: /note="Description of Artificial Sequence: Synthetic polypeptide"

SEQ ID NO: 1437 - protein, 108 aa, Artificial Sequence; identical to SEQ ID NO: 1397
  source: /note="Description of Artificial Sequence: Synthetic polypeptide"

SEQ ID NO: 1438 - protein, 5 aa, Artificial Sequence
  source: /note="Description of Artificial Sequence: Synthetic peptide"
TVAAP

SEQ ID NO: 1439 - protein, 111 aa, Artificial Sequence; identical to SEQ ID NO: 799
  source: /note="Description of Artificial Sequence: Synthetic polypeptide"

SEQ ID NO: 1440 - protein, 105 aa, Artificial Sequence; identical to SEQ ID NO: 30
  source: /note="Description of Artificial Sequence: Synthetic polypeptide"

SEQ ID NO: 1441 - protein, 246 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 1442 - protein, 117 aa, Artificial Sequence; identical to SEQ ID NO: 1392
  source: /note="Description of Artificial Sequence: Synthetic polypeptide"

SEQ ID NO: 1443 - protein, 10 aa, Artificial Sequence
  source: /note="Description of Artificial Sequence: Synthetic peptide"
GGGGSGGGGS

SEQ ID NO: 1444 - protein, 119 aa, Artificial Sequence; identical to SEQ ID NO: 844
  source: /note="Description of Artificial Sequence: Synthetic polypeptide"

SEQ ID NO: 1445 - protein, 330 aa, Artificial Sequence; identical to SEQ ID NO: 25
  source: /note="Description of Artificial Sequence: Synthetic polypeptide"

SEQ ID NO: 1446 - protein, 229 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRGGSGGGGSGQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 1447 - protein, 108 aa, Artificial Sequence; identical to SEQ ID NO: 1397
  source: /note="Description of Artificial Sequence: Synthetic polypeptide"

SEQ ID NO: 1448 - protein, 9 aa, Artificial Sequence
  source: /note="Description of Artificial Sequence: Synthetic peptide"
GGSGGGGSG

SEQ ID NO: 1449 - protein, 112 aa, Artificial Sequence; identical to SEQ ID NO: 849
  source: /note="Description of Artificial Sequence: Synthetic polypeptide"

SEQ ID NO: 1450 - protein, 105 aa, Artificial Sequence; identical to SEQ ID NO: 30
  source: /note="Description of Artificial Sequence: Synthetic polypeptide"

SEQ ID NO: 1451 - protein, 242 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 1452 - protein, 117 aa, Artificial Sequence; identical to SEQ ID NO: 1392
  source: /note="Description of Artificial Sequence: Synthetic polypeptide"

SEQ ID NO: 1453 - protein, 6 aa, Artificial Sequence
  source: /note="Description of Artificial Sequence: Synthetic peptide"
ASTKGP

SEQ ID NO: 1454 - protein, 119 aa, Artificial Sequence; identical to SEQ ID NO: 844
  source: /note="Description of Artificial Sequence: Synthetic polypeptide"

SEQ ID NO: 1455 - protein, 330 aa, Artificial Sequence; identical to SEQ ID NO: 25
  source: /note="Description of Artificial Sequence: Synthetic polypeptide"

SEQ ID NO: 1456 - protein, 225 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 1457 - protein, 108 aa, Artificial Sequence; identical to SEQ ID NO: 1397
  source: /note="Description of Artificial Sequence: Synthetic polypeptide"

SEQ ID NO: 1458 - protein, 5 aa, Artificial Sequence
  source: /note="Description of Artificial Sequence: Synthetic peptide"
TVAAP

SEQ ID NO: 1459 - protein, 112 aa, Artificial Sequence; identical to SEQ ID NO: 849
  source: /note="Description of Artificial Sequence: Synthetic polypeptide"

SEQ ID NO: 1460 - protein, 105 aa, Artificial Sequence; identical to SEQ ID NO: 30
  source: /note="Description of Artificial Sequence: Synthetic polypeptide"

SEQ ID NO: 1461 - protein, 249 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPSVFPLAPEVQLVESGGGLVQPGRSLRLSCAASGFTFDDYALHWVRQAPGKGLEWVSGIGWEDDMIDYADSVKGRFTISRDNAKNSLYLQMNSLRVEDTALYYCAGNSRGYGGLDVWGQGTTVTVSS

SEQ ID NO: 1462 - protein, 117 aa, Artificial Sequence; identical to SEQ ID NO: 1392
  source: /note="Description of Artificial Sequence: Synthetic polypeptide"

SEQ ID NO: 1463 - protein, 13 aa, Artificial Sequence
  source: /note="Description of Artificial Sequence: Synthetic peptide"
ASTKGPSVFPLAP

SEQ ID NO: 1464 - protein, 119 aa, Artificial Sequence; identical to SEQ ID NO: 844
  source: /note="Description of Artificial Sequence: Synthetic polypeptide"

SEQ ID NO: 1465 - protein, 330 aa, Artificial Sequence; identical to SEQ ID NO: 25
  source: /note="Description of Artificial Sequence: Synthetic polypeptide"

SEQ ID NO: 1466 - protein, 232 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPSVFIFPPQSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVLG

SEQ ID NO: 1467 - protein, 108 aa, Artificial Sequence; identical to SEQ ID NO: 1397
  source: /note="Description of Artificial Sequence: Synthetic polypeptide"

SEQ ID NO: 1468 - protein, 12 aa, Artificial Sequence
  source: /note="Description of Artificial Sequence: Synthetic peptide"
TVAAPSVFIFPP

SEQ ID NO: 1469 - protein, 112 aa, Artificial Sequence; identical to SEQ ID NO: 849
  source: /note="Description of Artificial Sequence: Synthetic polypeptide"

SEQ ID NO: 1470 - protein, 105 aa, Artificial Sequence; identical to SEQ ID NO: 30
  source: /note="Description of Artificial Sequence: Synthetic polypeptide"

SEQ ID NO: 1471 - protein, 242 aa, Artificial Sequence; identical to SEQ ID NO: 1451
  source: /note="Description of Artificial Sequence: Synthetic polypeptide"

SEQ ID NO: 1472 - protein, 117 aa, Artificial Sequence; identical to SEQ ID NO: 1392
  source: /note="Description of Artificial Sequence: Synthetic polypeptide"

SEQ ID NO: 1473 - protein, 6 aa, Artificial Sequence
  source: /note="Description of Artificial Sequence: Synthetic peptide"
ASTKGP

SEQ ID NO: 1474 - protein, 119 aa, Artificial Sequence; identical to SEQ ID NO: 844
  source: /note="Description of Artificial Sequence: Synthetic polypeptide"

SEQ ID NO: 1475 - protein, 330 aa, Artificial Sequence; identical to SEQ ID NO: 25
  source: /note="Description of Artificial Sequence: Synthetic polypeptide"

SEQ ID NO: 1476 - protein, 232 aa, Artificial Sequence; identical to SEQ ID NO: 1466
  source: /note="Description of Artificial Sequence: Synthetic polypeptide"

SEQ ID NO: 1477 - protein, 108 aa, Artificial Sequence; identical to SEQ ID NO: 1397
  source: /note="Description of Artificial Sequence: Synthetic polypeptide"

SEQ ID NO: 1478 - protein, 12 aa, Artificial Sequence
  source: /note="Description of Artificial Sequence: Synthetic peptide"
TVAAPSVFIFPP

SEQ ID NO: 1479 - protein, 112 aa, Artificial Sequence; identical to SEQ ID NO: 849
  source: /note="Description of Artificial Sequence: Synthetic polypeptide"

SEQ ID NO: 1480 - protein, 105 aa, Artificial Sequence; identical to SEQ ID NO: 30
  source: /note="Description of Artificial Sequence: Synthetic polypeptide"

SEQ ID NO: 1481 - protein, 249 aa, Artificial Sequence; identical to SEQ ID NO: 1461
  source: /note="Description of Artificial Sequence: Synthetic polypeptide"

SEQ ID NO: 1482 - protein, 117 aa, Artificial Sequence; identical to SEQ ID NO: 1392
  source: /note="Description of Artificial Sequence: Synthetic polypeptide"

SEQ ID NO: 1483 - protein, 13 aa, Artificial Sequence
  source: /note="Description of Artificial Sequence: Synthetic peptide"
ASTKGPSVFPLAP

SEQ ID NO: 1484 - protein, 119 aa, Artificial Sequence; identical to SEQ ID NO: 844
  source: /note="Description of Artificial Sequence: Synthetic polypeptide"

SEQ ID NO: 1485 - protein, 330 aa, Artificial Sequence; identical to SEQ ID NO: 25
  source: /note="Description of Artificial Sequence: Synthetic polypeptide"

SEQ ID NO: 1486 - protein, 225 aa, Artificial Sequence; identical to SEQ ID NO: 1456
  source: /note="Description of Artificial Sequence: Synthetic polypeptide"

SEQ ID NO: 1487 - protein, 108 aa, Artificial Sequence; identical to SEQ ID NO: 1397
  source: /note="Description of Artificial Sequence: Synthetic polypeptide"

SEQ ID NO: 1488 - protein, 5 aa, Artificial Sequence
  source: /note="Description of Artificial Sequence: Synthetic peptide"
TVAAP

SEQ ID NO: 1489 - protein, 112 aa, Artificial Sequence; identical to SEQ ID NO: 849
  source: /note="Description of Artificial Sequence: Synthetic polypeptide"

SEQ ID NO: 1490 - protein, 105 aa, Artificial Sequence; identical to SEQ ID NO: 30
  source: /note="Description of Artificial Sequence: Synthetic polypeptide"

SEQ ID NO: 1491 - protein, 246 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 1492 - protein, 117 aa, Artificial Sequence; identical to SEQ ID NO: 1392
  source: /note="Description of Artificial Sequence: Synthetic polypeptide"

SEQ ID NO: 1493 - protein, 10 aa, Artificial Sequence
  source: /note="Description of Artificial Sequence: Synthetic peptide"
GGGGSGGGGS

SEQ ID NO: 1494 - protein, 119 aa, Artificial Sequence; identical to SEQ ID NO: 894
  source: /note="Description of Artificial Sequence: Synthetic polypeptide"

SEQ ID NO: 1495 - protein, 330 aa, Artificial Sequence; identical to SEQ ID NO: 25
  source: /note="Description of Artificial Sequence: Synthetic polypeptide"

SEQ ID NO: 1496 - protein, 229 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRGGSGGGGSGQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 1497 - protein, 108 aa, Artificial Sequence; identical to SEQ ID NO: 1397
  source: /note="Description of Artificial Sequence: Synthetic polypeptide"

SEQ ID NO: 1498 - protein, 9 aa, Artificial Sequence
  source: /note="Description of Artificial Sequence: Synthetic peptide"
GGSGGGGSG

SEQ ID NO: 1499 - protein, 112 aa, Artificial Sequence; identical to SEQ ID NO: 899
  source: /note="Description of Artificial Sequence: Synthetic polypeptide"

SEQ ID NO: 1500 - protein, 105 aa, Artificial Sequence; identical to SEQ ID NO: 30
  source: /note="Description of Artificial Sequence: Synthetic polypeptide"

SEQ ID NO: 1501 - protein, 242 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPEVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 1502 - protein, 117 aa, Artificial Sequence; identical to SEQ ID NO: 1392
  source: /note="Description of Artificial Sequence: Synthetic polypeptide"

SEQ ID NO: 1503 - protein, 6 aa, Artificial Sequence
  source: /note="Description of Artificial Sequence: Synthetic peptide"
ASTKGP

SEQ ID NO: 1504 - protein, 119 aa, Artificial Sequence; identical to SEQ ID NO: 894
  source: /note="Description of Artificial Sequence: Synthetic polypeptide"

SEQ ID NO: 1505 - protein, 330 aa, Artificial Sequence; identical to SEQ ID NO: 25
  source: /note="Description of Artificial Sequence: Synthetic polypeptide"

SEQ ID NO: 1506 - protein, 225 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 1507 - protein, 108 aa, Artificial Sequence; identical to SEQ ID NO: 1397
  source: /note="Description of Artificial Sequence: Synthetic polypeptide"

SEQ ID NO: 1508 - protein, 5 aa, Artificial Sequence
  source: /note="Description of Artificial Sequence: Synthetic peptide"
TVAAP

SEQ ID NO: 1509 - protein, 112 aa, Artificial Sequence; identical to SEQ ID NO: 899
  source: /note="Description of Artificial Sequence: Synthetic polypeptide"

SEQ ID NO: 1510 - protein, 105 aa, Artificial Sequence; identical to SEQ ID NO: 30
  source: /note="Description of Artificial Sequence: Synthetic polypeptide"

SEQ ID NO: 1511 - protein, 249 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPSVFPLAPEVQLVESGGGLVQPGRSLRLSCAASGFTFDDYALHWVRQAPGKGLEWVSGIGWDEDMIDYADSVKGRFTISRDNAKNSLYLQMNSLRVEDTALYYCAGNNRGYGGLDVWGQGTTVTVSS

SEQ ID NO: 1512 - protein, 117 aa, Artificial Sequence; identical to SEQ ID NO: 1392
  source: /note="Description of Artificial Sequence: Synthetic polypeptide"

SEQ ID NO: 1513 - protein, 13 aa, Artificial Sequence
  source: /note="Description of Artificial Sequence: Synthetic peptide"
ASTKGPSVFPLAP

SEQ ID NO: 1514 - protein, 119 aa, Artificial Sequence; identical to SEQ ID NO: 894
  source: /note="Description of Artificial Sequence: Synthetic polypeptide"

SEQ ID NO: 1515 - protein, 330 aa, Artificial Sequence; identical to SEQ ID NO: 25
  source: /note="Description of Artificial Sequence: Synthetic polypeptide"

SEQ ID NO: 1516 - protein, 232 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPSVFIFPPQSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVLG

SEQ ID NO: 1517 - protein, 108 aa, Artificial Sequence; identical to SEQ ID NO: 1397
  source: /note="Description of Artificial Sequence: Synthetic polypeptide"

SEQ ID NO: 1518 - protein, 12 aa, Artificial Sequence
  source: /note="Description of Artificial Sequence: Synthetic peptide"
TVAAPSVFIFPP

SEQ ID NO: 1519 - protein, 112 aa, Artificial Sequence; identical to SEQ ID NO: 899
  source: /note="Description of Artificial Sequence: Synthetic polypeptide"

SEQ ID NO: 1520 - protein, 105 aa, Artificial Sequence; identical to SEQ ID NO: 30
  source: /note="Description of Artificial Sequence: Synthetic polypeptide"

SEQ ID NO: 1521 - protein, 242 aa, Artificial Sequence; identical to SEQ ID NO: 1501
  source: /note="Description of Artificial Sequence: Synthetic polypeptide"

SEQ ID NO: 1522 - protein, 117 aa, Artificial Sequence; identical to SEQ ID NO: 1392
  source: /note="Description of Artificial Sequence: Synthetic polypeptide"

SEQ ID NO: 1523 - protein, 6 aa, Artificial Sequence
  source: /note="Description of Artificial Sequence: Synthetic peptide"
ASTKGP

SEQ ID NO: 1524 - protein, 119 aa, Artificial Sequence; identical to SEQ ID NO: 894
  source: /note="Description of Artificial Sequence: Synthetic polypeptide"

SEQ ID NO: 1525 - protein, 330 aa, Artificial Sequence; identical to SEQ ID NO: 25
  source: /note="Description of Artificial Sequence: Synthetic polypeptide"

SEQ ID NO: 1526 - protein, 232 aa, Artificial Sequence; identical to SEQ ID NO: 1516
  source: /note="Description of Artificial Sequence: Synthetic polypeptide"

SEQ ID NO: 1527 - protein, 108 aa, Artificial Sequence; identical to SEQ ID NO: 1397
  source: /note="Description of Artificial Sequence: Synthetic polypeptide"

SEQ ID NO: 1528 - protein, 12 aa, Artificial Sequence
  source: /note="Description of Artificial Sequence: Synthetic peptide"
TVAAPSVFIFPP

SEQ ID NO: 1529 - protein, 112 aa, Artificial Sequence; identical to SEQ ID NO: 899
  source: /note="Description of Artificial Sequence: Synthetic polypeptide"

SEQ ID NO: 1530 - protein, 105 aa, Artificial Sequence; identical to SEQ ID NO: 30
  source: /note="Description of Artificial Sequence: Synthetic polypeptide"

SEQ ID NO: 1531 - protein, 249 aa, Artificial Sequence; identical to SEQ ID NO: 1511
  source: /note="Description of Artificial Sequence: Synthetic polypeptide"

SEQ ID NO: 1532 - protein, 117 aa, Artificial Sequence; identical to SEQ ID NO: 1392
  source: /note="Description of Artificial Sequence: Synthetic polypeptide"

SEQ ID NO: 1533 - protein, 13 aa, Artificial Sequence
  source: /note="Description of Artificial Sequence: Synthetic peptide"
ASTKGPSVFPLAP

SEQ ID NO: 1534 - protein, 119 aa, Artificial Sequence; identical to SEQ ID NO: 894
  source: /note="Description of Artificial Sequence: Synthetic polypeptide"

SEQ ID NO: 1535 - protein, 330 aa, Artificial Sequence; identical to SEQ ID NO: 25
  source: /note="Description of Artificial Sequence: Synthetic polypeptide"

SEQ ID NO: 1536 - protein, 225 aa, Artificial Sequence; identical to SEQ ID NO: 1506
  source: /note="Description of Artificial Sequence: Synthetic polypeptide"

SEQ ID NO: 1537 - protein, 108 aa, Artificial Sequence; identical to SEQ ID NO: 1397
  source: /note="Description of Artificial Sequence: Synthetic polypeptide"

SEQ ID NO: 1538 - protein, 5 aa, Artificial Sequence
  source: /note="Description of Artificial Sequence: Synthetic peptide"
TVAAP

SEQ ID NO: 1539 - protein, 112 aa, Artificial Sequence; identical to SEQ ID NO: 899
  source: /note="Description of Artificial Sequence: Synthetic polypeptide"

SEQ ID NO: 1540 - protein, 105 aa, Artificial Sequence; identical to SEQ ID NO: 30
  source: /note="Description of Artificial Sequence: Synthetic polypeptide"

SEQ ID NO: 1541 - protein, 246 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 1542 - protein, 117 aa, Artificial Sequence; identical to SEQ ID NO: 1392
  source: /note="Description of Artificial Sequence: Synthetic polypeptide"

SEQ ID NO: 1543 - protein, 10 aa, Artificial Sequence
  source: /note="Description of Artificial Sequence: Synthetic peptide"
GGGGSGGGGS

SEQ ID NO: 1544 - protein, 119 aa, Artificial Sequence; identical to SEQ ID NO: 944
  source: /note="Description of Artificial Sequence: Synthetic polypeptide"

SEQ ID NO: 1545 - protein, 330 aa, Artificial Sequence; identical to SEQ ID NO: 25
  source: /note="Description of Artificial Sequence: Synthetic polypeptide"

SEQ ID NO: 1546 - protein, 228 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRGGSGGGGSGQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 1547 - protein, 108 aa, Artificial Sequence; identical to SEQ ID NO: 1397
  source: /note="Description of Artificial Sequence: Synthetic polypeptide"

SEQ ID NO: 1548 - protein, 9 aa, Artificial Sequence
  source: /note="Description of Artificial Sequence: Synthetic peptide"
GGSGGGGSG

SEQ ID NO: 1549 - protein, 111 aa, Artificial Sequence; identical to SEQ ID NO: 949
  source: /note="Description of Artificial Sequence: Synthetic polypeptide"

SEQ ID NO: 1550 - protein, 105 aa, Artificial Sequence; identical to SEQ ID NO: 30
  source: /note="Description of Artificial Sequence: Synthetic polypeptide"

SEQ ID NO: 1551 - protein, 242 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 1552 - protein, 117 aa, Artificial Sequence; identical to SEQ ID NO: 1392
  source: /note="Description of Artificial Sequence: Synthetic polypeptide"

SEQ ID NO: 1553 - protein, 6 aa, Artificial Sequence
  source: /note="Description of Artificial Sequence: Synthetic peptide"
ASTKGP

SEQ ID NO: 1554 - protein, 119 aa, Artificial Sequence; identical to SEQ ID NO: 944
  source: /note="Description of Artificial Sequence: Synthetic polypeptide"

SEQ ID NO: 1555 - protein, 330 aa, Artificial Sequence; identical to SEQ ID NO: 25
  source: /note="Description of Artificial Sequence: Synthetic polypeptide"

SEQ ID NO: 1556 - protein, 224 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 1557 - protein, 108 aa, Artificial Sequence; identical to SEQ ID NO: 1397
  source: /note="Description of Artificial Sequence: Synthetic polypeptide"

SEQ ID NO: 1558 - protein, 5 aa, Artificial Sequence
  source: /note="Description of Artificial Sequence: Synthetic peptide"
TVAAP

SEQ ID NO: 1559 - protein, 111 aa, Artificial Sequence; identical to SEQ ID NO: 949
  source: /note="Description of Artificial Sequence: Synthetic polypeptide"

SEQ ID NO: 1560 - protein, 105 aa, Artificial Sequence; identical to SEQ ID NO: 30
  source: /note="Description of Artificial Sequence: Synthetic polypeptide"

SEQ ID NO: 1561 - protein, 249 aa, Artificial Sequence
  source: /note="Description of Artificial Sequence: Synthetic polypeptide"
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPSVFPLAPEVQLVESGGGLVQPGRSLRLSCAASGFTFEDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 1562 - protein, 117 aa, Artificial Sequence; identical to SEQ ID NO: 1392
  source: /note="Description of Artificial Sequence: Synthetic polypeptide"

SEQ ID NO: 1563 - protein, 13 aa, Artificial Sequence
  source: /note="Description of Artificial Sequence: Synthetic peptide"
ASTKGPSVFPLAP

SEQ ID NO: 1564 - protein, 119 aa, Artificial Sequence; identical to SEQ ID NO: 944
  source: /note="Description of Artificial Sequence: Synthetic polypeptide"

SEQ ID NO: 1565 - protein, 330 aa, Artificial Sequence; identical to SEQ ID NO: 25
  source: /note="Description of Artificial Sequence: Synthetic polypeptide"

SEQ ID NO: 1566 - protein, 231 aa, Artificial Sequence
  source: /note="Description of Artificial Sequence: Synthetic polypeptide"
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPSVFIFPPQSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVLG

SEQ ID NO: 1567 - protein, 108 aa, Artificial Sequence; identical to SEQ ID NO: 1397
  source: /note="Description of Artificial Sequence: Synthetic polypeptide"

SEQ ID NO: 1568 - protein, 12 aa, Artificial Sequence
  source: /note="Description of Artificial Sequence: Synthetic peptide"
TVAAPSVFIFPP

SEQ ID NO: 1569 - protein, 111 aa, Artificial Sequence; identical to SEQ ID NO: 949
  source: /note="Description of Artificial Sequence: Synthetic polypeptide"

SEQ ID NO: 1570 - protein, 105 aa, Artificial Sequence; identical to SEQ ID NO: 30
  source: /note="Description of Artificial Sequence: Synthetic polypeptide"

SEQ ID NO: 1571 - protein, 242 aa, Artificial Sequence; identical to SEQ ID NO: 1551
  source: /note="Description of Artificial Sequence: Synthetic polypeptide"

SEQ ID NO: 1572 - protein, 117 aa, Artificial Sequence; identical to SEQ ID NO: 1392
  source: /note="Description of Artificial Sequence: Synthetic polypeptide"

SEQ ID NO: 1573 - protein, 6 aa, Artificial Sequence
  source: /note="Description of Artificial Sequence: Synthetic peptide"
ASTKGP

SEQ ID NO: 1574 - protein, 119 aa, Artificial Sequence; identical to SEQ ID NO: 944
  source: /note="Description of Artificial Sequence: Synthetic polypeptide"

SEQ ID NO: 1575 - protein, 330 aa, Artificial Sequence; identical to SEQ ID NO: 25
  source: /note="Description of Artificial Sequence: Synthetic polypeptide"

SEQ ID NO: 1576 - protein, 231 aa, Artificial Sequence; identical to SEQ ID NO: 1566
  source: /note="Description of Artificial Sequence: Synthetic polypeptide"

SEQ ID NO: 1577 - protein, 108 aa, Artificial Sequence; identical to SEQ ID NO: 1397
  source: /note="Description of Artificial Sequence: Synthetic polypeptide"

SEQ ID NO: 1578 - protein, 12 aa, Artificial Sequence
  source: /note="Description of Artificial Sequence: Synthetic peptide"
TVAAPSVFIFPP

SEQ ID NO: 1579 - protein, 111 aa, Artificial Sequence; identical to SEQ ID NO: 949
  source: /note="Description of Artificial Sequence: Synthetic polypeptide"

SEQ ID NO: 1580 - protein, 105 aa, Artificial Sequence; identical to SEQ ID NO: 30
  source: /note="Description of Artificial Sequence: Synthetic polypeptide"

SEQ ID NO: 1581 - protein, 249 aa, Artificial Sequence; identical to SEQ ID NO: 1561
  source: /note="Description of Artificial Sequence: Synthetic polypeptide"

SEQ ID NO: 1582 - protein, 117 aa, Artificial Sequence; identical to SEQ ID NO: 1392
  source: /note="Description of Artificial Sequence: Synthetic polypeptide"

SEQ ID NO: 1583 - protein, 13 aa, Artificial Sequence
  source: /note="Description of Artificial Sequence: Synthetic peptide"
ASTKGPSVFPLAP

SEQ ID NO: 1584 - protein, 119 aa, Artificial Sequence; identical to SEQ ID NO: 944
  source: /note="Description of Artificial Sequence: Synthetic polypeptide"

SEQ ID NO: 1585 - protein, 330 aa, Artificial Sequence; identical to SEQ ID NO: 25
  source: /note="Description of Artificial Sequence: Synthetic polypeptide"

SEQ ID NO: 1586 - protein, 224 aa, Artificial Sequence; identical to SEQ ID NO: 1556
  source: /note="Description of Artificial Sequence: Synthetic polypeptide"

SEQ ID NO: 1587 - protein, 108 aa, Artificial Sequence; identical to SEQ ID NO: 1397
  source: /note="Description of Artificial Sequence: Synthetic polypeptide"

SEQ ID NO: 1588 - protein, 5 aa, Artificial Sequence
  source: /note="Description of Artificial Sequence: Synthetic peptide"
TVAAP

SEQ ID NO: 1589 - protein, 111 aa, Artificial Sequence; identical to SEQ ID NO: 949
  source: /note="Description of Artificial Sequence: Synthetic polypeptide"

SEQ ID NO: 1590 - protein, 105 aa, Artificial Sequence; identical to SEQ ID NO: 30
  source: /note="Description of Artificial Sequence: Synthetic polypeptide"

SEQ ID NO: 1591 - protein, 246 aa, Artificial Sequence
  source: /note="Description of Artificial Sequence: Synthetic polypeptide"
EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSSGGGGSGGGGSEVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS

SEQ ID NO: 1592 - protein, 119 aa, Artificial Sequence; identical to SEQ ID NO: 794
  source: /note="Description of Artificial Sequence: Synthetic polypeptide"

SEQ ID NO: 1593 - protein, 10 aa, Artificial Sequence
  source: /note="Description of Artificial Sequence: Synthetic peptide"
GGGGSGGGGS

SEQ ID NO: 1594 - protein, 117 aa, Artificial Sequence; identical to SEQ ID NO: 662
  source: /note="Description of Artificial Sequence: Synthetic polypeptide"

SEQ ID NO: 1595 - protein, 330 aa, Artificial Sequence; identical to SEQ ID NO: 25
  source: /note="Description of Artificial Sequence: Synthetic polypeptide"

SEQ ID NO: 1596 - protein, 228 aa, Artificial Sequence
  source: /note="Description of Artificial Sequence: Synthetic polypeptide"
QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLGGGSGGGGSGDIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR

SEQ ID NO: 1597 - protein, 111 aa, Artificial Sequence; identical to SEQ ID NO: 799
  source: /note="Description of Artificial Sequence: Synthetic polypeptide"

SEQ ID NO: 1598 - protein, 9 aa, Artificial Sequence
  source: /note="Description of Artificial Sequence: Synthetic peptide"
GGSGGGGSG

SEQ ID NO: 1599 - protein, 108 aa, Artificial Sequence; identical to SEQ ID NO: 677
  source: /note="Description of Artificial Sequence: Synthetic polypeptide"

SEQ ID NO: 1600 - protein, 106 aa, Artificial Sequence; identical to SEQ ID NO: 40
  source: /note="Description of Artificial Sequence: Synthetic polypeptide"

SEQ ID NO: 1601 - protein, 242 aa, Artificial Sequence
  source: /note="Description of Artificial Sequence: Synthetic polypeptide"
EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSSASTKGPEVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS

SEQ ID NO: 1602 - protein, 119 aa, Artificial Sequence; identical to SEQ ID NO: 794
  source: /note="Description of Artificial Sequence: Synthetic polypeptide"

SEQ ID NO: 1603 - protein, 6 aa, Artificial Sequence
  source: /note="Description of Artificial Sequence: Synthetic peptide"
ASTKGP

SEQ ID NO: 1604 - protein, 117 aa, Artificial Sequence; identical to SEQ ID NO: 662
  source: /note="Description of Artificial Sequence: Synthetic polypeptide"

SEQ ID NO: 1605 - protein, 330 aa, Artificial Sequence; identical to SEQ ID NO: 25
  source: /note="Description of Artificial Sequence: Synthetic polypeptide"

SEQ ID NO: 1606 - protein, 225 aa, Artificial Sequence
  source: /note="Description of Artificial Sequence: Synthetic polypeptide"
QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLGQPKAAPDIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR

SEQ ID NO: 1607 - protein, 111 aa, Artificial Sequence; identical to SEQ ID NO: 799
  source: /note="Description of Artificial Sequence: Synthetic polypeptide"

SEQ ID NO: 1608 - protein, 6 aa, Artificial Sequence
  source: /note="Description of Artificial Sequence: Synthetic peptide"
QPKAAP

SEQ ID NO: 1609 - protein, 108 aa, Artificial Sequence; identical to SEQ ID NO: 677
  source: /note="Description of Artificial Sequence: Synthetic polypeptide"

SEQ ID NO: 1610 - protein, 106 aa, Artificial Sequence; identical to SEQ ID NO: 40
  source: /note="Description of Artificial Sequence: Synthetic polypeptide"

SEQ ID NO: 1611 - protein, 249 aa, Artificial Sequence
  source: /note="Description of Artificial Sequence: Synthetic polypeptide"
EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSSASTKGPSVFPLAPEVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS

SEQ ID NO: 1612 - protein, 119 aa, Artificial Sequence; identical to SEQ ID NO: 794
  source: /note="Description of Artificial Sequence: Synthetic polypeptide"

SEQ ID NO: 1613 - protein, 13 aa, Artificial Sequence
  source: /note="Description of Artificial Sequence: Synthetic peptide"
ASTKGPSVFPLAP

SEQ ID NO: 1614 - protein, 117 aa, Artificial Sequence; identical to SEQ ID NO: 662
  source: /note="Description of Artificial Sequence: Synthetic polypeptide"

SEQ ID NO: 1615 - protein, 330 aa, Artificial Sequence; identical to SEQ ID NO: 25
  source: /note="Description of Artificial Sequence: Synthetic polypeptide"

SEQ ID NO: 1616 - protein, 232 aa, Artificial Sequence
  source: /note="Description of Artificial Sequence: Synthetic polypeptide"
QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLGQPKAAPSVTLFPPDIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR

SEQ ID NO: 1617 - protein, 111 aa, Artificial Sequence; identical to SEQ ID NO: 799
  source: /note="Description of Artificial Sequence: Synthetic polypeptide"

SEQ ID NO: 1618 - protein, 13 aa, Artificial Sequence
  source: /note="Description of Artificial Sequence: Synthetic peptide"
QPKAAPSVTLFPP

SEQ ID NO: 1619 - protein, 108 aa, Artificial Sequence; identical to SEQ ID NO: 677
  source: /note="Description of Artificial Sequence: Synthetic polypeptide"

SEQ ID NO: 1620 - protein, 106 aa, Artificial Sequence; identical to SEQ ID NO: 40
  source: /note="Description of Artificial Sequence: Synthetic polypeptide"

SEQ ID NO: 1621 - protein, 242 aa, Artificial Sequence; identical to SEQ ID NO: 1601
  source: /note="Description of Artificial Sequence: Synthetic polypeptide"

SEQ ID NO: 1622 - protein, 119 aa, Artificial Sequence; identical to SEQ ID NO: 794
  source: /note="Description of Artificial Sequence: Synthetic polypeptide"

SEQ ID NO: 1623 - protein, 6 aa, Artificial Sequence
  source: /note="Description of Artificial Sequence: Synthetic peptide"
ASTKGP

SEQ ID NO: 1624 - protein, 117 aa, Artificial Sequence; identical to SEQ ID NO: 662
  source: /note="Description of Artificial Sequence: Synthetic polypeptide"

SEQ ID NO: 1625 - protein, 330 aa, Artificial Sequence; identical to SEQ ID NO: 25
  source: /note="Description of Artificial Sequence: Synthetic polypeptide"

SEQ ID NO: 1626 - protein, 232 aa, Artificial Sequence; identical to SEQ ID NO: 1616
  source: /note="Description of Artificial Sequence: Synthetic polypeptide"

SEQ ID NO: 1627 - protein, 111 aa, Artificial Sequence; identical to SEQ ID NO: 799
  source: /note="Description of Artificial Sequence: Synthetic polypeptide"

SEQ ID NO: 1628 - protein, 13 aa, Artificial Sequence
  source: /note="Description of Artificial Sequence: Synthetic peptide"
QPKAAPSVTLFPP

SEQ ID NO: 1629 - protein, 108 aa, Artificial Sequence; identical to SEQ ID NO: 677
  source: /note="Description of Artificial Sequence: Synthetic polypeptide"

SEQ ID NO: 1630 - protein, 106 aa, Artificial Sequence; identical to SEQ ID NO: 40
  source: /note="Description of Artificial Sequence: Synthetic polypeptide"

SEQ ID NO: 1631 - protein, 249 aa, Artificial Sequence; identical to SEQ ID NO: 1611
  source: /note="Description of Artificial Sequence: Synthetic polypeptide"

SEQ ID NO: 1632 - protein, 119 aa, Artificial Sequence; identical to SEQ ID NO: 794
  source: /note="Description of Artificial Sequence: Synthetic polypeptide"

SEQ ID NO: 1633 - protein, 13 aa, Artificial Sequence
  source: /note="Description of Artificial Sequence: Synthetic peptide"
ASTKGPSVFPLAP

SEQ ID NO: 1634 - protein, 117 aa, Artificial Sequence; identical to SEQ ID NO: 662
  source: /note="Description of Artificial Sequence: Synthetic polypeptide"

SEQ ID NO: 1635 - protein, 330 aa, Artificial Sequence; identical to SEQ ID NO: 25
  source: /note="Description of Artificial Sequence: Synthetic polypeptide"

SEQ ID NO: 1636 - protein, 225 aa, Artificial Sequence; identical to SEQ ID NO: 1606
  source: /note="Description of Artificial Sequence: Synthetic polypeptide"

SEQ ID NO: 1637 - protein, 111 aa, Artificial Sequence; identical to SEQ ID NO: 799
  source: /note="Description of Artificial Sequence: Synthetic polypeptide"

SEQ ID NO: 1638 - protein, 6 aa, Artificial Sequence
  source: /note="Description of Artificial Sequence: Synthetic peptide"
QPKAAP

SEQ ID NO: 1639 - protein, 108 aa, Artificial Sequence; identical to SEQ ID NO: 677
  source: /note="Description of Artificial Sequence: Synthetic polypeptide"

SEQ ID NO: 1640 - protein, 106 aa, Artificial Sequence; identical to SEQ ID NO: 40
  source: /note="Description of Artificial Sequence: Synthetic polypeptide"

SEQ ID NO: 1641 - protein, 246 aa, Artificial Sequence
  source: /note="Description of Artificial Sequence: Synthetic polypeptide"
EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSSGGGGSGGGGSEVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS

SEQ ID NO: 1642 - protein, 119 aa, Artificial Sequence; identical to SEQ ID NO: 794
  source: /note="Description of Artificial Sequence: Synthetic polypeptide"

SEQ ID NO: 1643 - protein, 10 aa, Artificial Sequence
  source: /note="Description of Artificial Sequence: Synthetic peptide"
GGGGSGGGGS

SEQ ID NO: 1644 - protein, 117 aa, Artificial Sequence; identical to SEQ ID NO: 1392
  source: /note="Description of Artificial Sequence: Synthetic polypeptide"

SEQ ID NO: 1645 - protein, 330 aa, Artificial Sequence; identical to SEQ ID NO: 25
  source: /note="Description of Artificial Sequence: Synthetic polypeptide"

SEQ ID NO: 1646 - protein, 228 aa, Artificial Sequence
  source: /note="Description of Artificial Sequence: Synthetic polypeptide"
QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLGGGSGGGGSGDIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKR

SEQ ID NO: 1647 - protein, 111 aa, Artificial Sequence; identical to SEQ ID NO: 799
  source: /note="Description of Artificial Sequence: Synthetic polypeptide"

SEQ ID NO: 1648 - protein, 9 aa, Artificial Sequence
  source: /note="Description of Artificial Sequence: Synthetic peptide"
GGSGGGGSG

SEQ ID NO: 1649 - protein, 108 aa, Artificial Sequence; identical to SEQ ID NO: 1397
  source: /note="Description of Artificial Sequence: Synthetic polypeptide"

SEQ ID NO: 1650 - protein, 106 aa, Artificial Sequence; identical to SEQ ID NO: 40
  source: /note="Description of Artificial Sequence: Synthetic polypeptide"

SEQ ID NO: 1651 - protein, 242 aa, Artificial Sequence
  source: /note="Description of Artificial Sequence: Synthetic polypeptide"
EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSSASTKGPEVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS

SEQ ID NO: 1652 - protein, 119 aa, Artificial Sequence; identical to SEQ ID NO: 794
  source: /note="Description of Artificial Sequence: Synthetic polypeptide"

SEQ ID NO: 1653 - protein, 6 aa, Artificial Sequence
  source: /note="Description of Artificial Sequence: Synthetic peptide"
ASTKGP

SEQ ID NO: 1654 - protein, 117 aa, Artificial Sequence; identical to SEQ ID NO: 1392
  source: /note="Description of Artificial Sequence: Synthetic polypeptide"

SEQ ID NO: 1655 - protein, 330 aa, Artificial Sequence; identical to SEQ ID NO: 25
  source: /note="Description of Artificial Sequence: Synthetic polypeptide"

SEQ ID NO: 1656 - protein, 225 aa, Artificial Sequence
  source: /note="Description of Artificial Sequence: Synthetic polypeptide"
QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLGQPKAAPDIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKR

SEQ ID NO: 1657 - protein, 111 aa, Artificial Sequence; identical to SEQ ID NO: 799
  source: /note="Description of Artificial Sequence: Synthetic polypeptide"

SEQ ID NO: 1658 - protein, 6 aa, Artificial Sequence
  source: /note="Description of Artificial Sequence: Synthetic peptide"
QPKAAP

SEQ ID NO: 1659 - protein, 108 aa, Artificial Sequence; identical to SEQ ID NO: 1397
  source: /note="Description of Artificial Sequence: Synthetic polypeptide"

SEQ ID NO: 1660 - protein, 106 aa, Artificial Sequence; identical to SEQ ID NO: 40
  source: /note="Description of Artificial Sequence: Synthetic polypeptide"

SEQ ID NO: 1661 - protein, 249 aa, Artificial Sequence
  source: /note="Description of Artificial Sequence: Synthetic polypeptide"
EVQLVESGGGLVQPGRSLRLSCAASGFTFDDYALHWVRQAPGKGLEWVSGINWEGDDIDYADSVKGRFTISRDNAKNSLYLQMNSLRVEDTALYYCAGNSRGYGGLDVWGQGTTVTVSSASTKGPSVFPLAPEVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS

SEQ ID NO: 1662 - protein, 119 aa, Artificial Sequence; identical to SEQ ID NO: 794
  source: /note="Description of Artificial Sequence: Synthetic polypeptide"

SEQ ID NO: 1663 - protein, 13 aa, Artificial Sequence
  source: /note="Description of Artificial Sequence: Synthetic peptide"
ASTKGPSVFPLAP

SEQ ID NO: 1664 - protein, 117 aa, Artificial Sequence; identical to SEQ ID NO: 1392
  source: /note="Description of Artificial Sequence: Synthetic polypeptide"

SEQ ID NO: 1665 - protein, 330 aa, Artificial Sequence; identical to SEQ ID NO: 25
  source: /note="Description of Artificial Sequence: Synthetic polypeptide"

SEQ ID NO: 1666 - protein, 232 aa, Artificial Sequence
  source: /note="Description of Artificial Sequence: Synthetic polypeptide"
QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVLGQPKAAPSVTLFPPDIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKR

SEQ ID NO: 1667 - protein, 111 aa, Artificial Sequence; identical to SEQ ID NO: 799
  source: /note="Description of Artificial Sequence: Synthetic polypeptide"

SEQ ID NO: 1668 - protein, 13 aa, Artificial Sequence
  source: /note="Description of Artificial Sequence: Synthetic peptide"
QPKAAPSVTLFPP

SEQ ID NO: 1669 - protein, 108 aa, Artificial Sequence; identical to SEQ ID NO: 1397
  source: /note="Description of Artificial Sequence: Synthetic polypeptide"

SEQ ID NO: 1670 - protein, 106 aa, Artificial Sequence; identical to SEQ ID NO: 40
  source: /note="Description of Artificial Sequence: Synthetic polypeptide"

SEQ ID NO: 1671 - protein, 242 aa, Artificial Sequence; identical to SEQ ID NO: 1651
  source: /note="Description of Artificial Sequence: Synthetic polypeptide"

SEQ ID NO: 1672 - protein, 119 aa, Artificial Sequence; identical to SEQ ID NO: 794
  source: /note="Description of Artificial Sequence: Synthetic polypeptide"

SEQ ID NO: 1673 - protein, 6 aa, Artificial Sequence
  source: /note="Description of Artificial Sequence: Synthetic peptide"
ASTKGP

SEQ ID NO: 1674 - protein, 117 aa, Artificial Sequence; identical to SEQ ID NO: 1392
  source: /note="Description of Artificial Sequence: Synthetic polypeptide"

SEQ ID NO: 1675 - protein, 330 aa, Artificial Sequence; identical to SEQ ID NO: 25
  source: /note="Description of Artificial Sequence: Synthetic polypeptide"

SEQ ID NO: 1676 - protein, 232 aa, Artificial Sequence; identical to SEQ ID NO: 1666
  source: /note="Description of Artificial Sequence: Synthetic polypeptide"

SEQ ID NO: 1677 - protein, 111 aa, Artificial Sequence; identical to SEQ ID NO: 799
  source: /note="Description of Artificial Sequence: Synthetic polypeptide"

SEQ ID NO: 1678 - protein, 13 aa, Artificial Sequence
  source: /note="Description of Artificial Sequence: Synthetic peptide"
QPKAAPSVTLFPP

SEQ ID NO: 1679 - protein, 108 aa, Artificial Sequence; identical to SEQ ID NO: 1397
  source: /note="Description of Artificial Sequence: Synthetic polypeptide"

SEQ ID NO: 1680 - protein, 106 aa, Artificial Sequence; identical to SEQ ID NO: 40
  source: /note="Description of Artificial Sequence: Synthetic polypeptide"

SEQ ID NO: 1681 - protein, 249 aa, Artificial Sequence; identical to SEQ ID NO: 1661
  source: /note="Description of Artificial Sequence: Synthetic polypeptide"

SEQ ID NO: 1682 - protein, 119 aa, Artificial Sequence; identical to SEQ ID NO: 794
  source: /note="Description of Artificial Sequence: Synthetic polypeptide"

SEQ ID NO: 1683 - protein, 13 aa, Artificial Sequence
  source: /note="Description of Artificial Sequence: Synthetic peptide"
ASTKGPSVFPLAP

SEQ ID NO: 1684 - protein, 117 aa, Artificial Sequence; identical to SEQ ID NO: 1392
  source: /note="Description of Artificial Sequence: Synthetic polypeptide"

SEQ ID NO: 1685 - protein, 330 aa, Artificial Sequence; identical to SEQ ID NO: 25
  source: /note="Description of Artificial Sequence: Synthetic polypeptide"

SEQ ID NO: 1686 - protein, 225 aa, Artificial Sequence; identical to SEQ ID NO: 1656
  source: /note="Description of Artificial Sequence: Synthetic polypeptide"

SEQ ID NO: 1687 - protein, 111 aa, Artificial Sequence; identical to SEQ ID NO: 799
  source: /note="Description of Artificial Sequence: Synthetic polypeptide"

SEQ ID NO: 1688 - protein, 6 aa, Artificial Sequence
  source: /note="Description of Artificial Sequence: Synthetic peptide"
QPKAAP

SEQ ID NO: 1689 - protein, 108 aa, Artificial Sequence; identical to SEQ ID NO: 1397
  source: /note="Description of Artificial Sequence: Synthetic polypeptide"

SEQ ID NO: 1690 - protein, 106 aa, Artificial Sequence; identical to SEQ ID NO: 40
  source: /note="Description of Artificial Sequence: Synthetic polypeptide"

SEQ ID NO: 1691-1693 - skipped (3 entries)

SEQ ID NO: 1694 - protein, 190 aa, Homo sapiens
QGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 1695 - protein, 6 aa, Artificial Sequence
  source: /note="Description of Artificial Sequence: Synthetic peptide"
GGGGSG

SEQ ID NO: 1696 - protein, 5 aa, Artificial Sequence
  source: /note="Description of Artificial Sequence: Synthetic peptide"
GGSGG

SEQ ID NO: 1697 - protein, 10 aa, Artificial Sequence
  source: /note="Description of Artificial Sequence: Synthetic peptide"
GGGGSGGGGS

SEQ ID NO: 1698 - protein, 10 aa, Artificial Sequence
  source: /note="Description of Artificial Sequence: Synthetic peptide"
GGSGGGGSGS

SEQ ID NO: 1699 - protein, 13 aa, Artificial Sequence
  source: /note="Description of Artificial Sequence: Synthetic peptide"
GGSGGGGSGGGGS

SEQ ID NO: 1700 - protein, 14 aa, Artificial Sequence
  source: /note="Description of Artificial Sequence: Synthetic peptide"
GGGGSGGGGSGGGG

SEQ ID NO: 1701 - protein, 15 aa, Artificial Sequence
  source: /note="Description of Artificial Sequence: Synthetic peptide"
GGGGSGGGGSGGGGS

SEQ ID NO: 1702 - protein, 6 aa, Artificial Sequence
  source: /note="Description of Artificial Sequence: Synthetic peptide"
ASTKGP

SEQ ID NO: 1703 - protein, 13 aa, Artificial Sequence
  source: /note="Description of Artificial Sequence: Synthetic peptide"
ASTKGPSVFPLAP

SEQ ID NO: 1704 - protein, 5 aa, Artificial Sequence
  source: /note="Description of Artificial Sequence: Synthetic peptide"
TVAAP

SEQ ID NO: 1705 - protein, 12 aa, Artificial Sequence
  source: /note="Description of Artificial Sequence: Synthetic peptide"
TVAAPSVFIFPP

SEQ ID NO: 1706 - protein, 16 aa, Artificial Sequence
  source: /note="Description of Artificial Sequence: Synthetic peptide"
AKTTPKLEEGEFSEAR

SEQ ID NO: 1707 - protein, 17 aa, Artificial Sequence
  source: /note="Description of Artificial Sequence: Synthetic peptide"
AKTTPKLEEGEFSEARV

SEQ ID NO: 1708 - skipped

SEQ ID NO: 1709 - protein, 10 aa, Artificial Sequence
  source: /note="Description of Artificial Sequence: Synthetic peptide"
SAKTTPKLGG

SEQ ID NO: 1710 - protein, 9 aa, Artificial Sequence
  source: /note="Description of Artificial Sequence: Synthetic peptide"
AKTTPKLGG

SEQ ID NO: 1711 - protein, 6 aa, Artificial Sequence
  source: /note="Description of Artificial Sequence: Synthetic peptide"
RADAAP

SEQ ID NO: 1712 - protein, 9 aa, Artificial Sequence
  source: /note="Description of Artificial Sequence: Synthetic peptide"
RADAAPTVS

SEQ ID NO: 1713 - protein, 12 aa, Artificial Sequence
  source: /note="Description of Artificial Sequence: Synthetic peptide"
RADAAAAGGPGS

SEQ ID NO: 1714 - protein, 27 aa, Artificial Sequence
  source: /note="Description of Artificial Sequence: Synthetic peptide"
RADAAAAGGGGSGGGGSGGGGSGGGGS

SEQ ID NO: 1715 - protein, 18 aa, Artificial Sequence
  source: /note="Description of Artificial Sequence: Synthetic peptide"
SAKTTPKLEEGEFSEARV

SEQ ID NO: 1716 - protein, 5 aa, Artificial Sequence
  source: /note="Description of Artificial Sequence: Synthetic peptide"
ADAAP

SEQ ID NO: 1717-1718 - skipped (2 entries)

SEQ ID NO: 1719 - protein, 121 aa, Homo sapiens
EVQLVQSGAEVKKPGASVKVSCKVSGYTLSELSMHWVRQAPGKGLEWMGGFDPEVGELIYAQKFQGRVTMTEDTSTDTAYMELSSLRSEDTAVYYCATDAGGFWYKFFQHWGPGTLVTVSS

SEQ ID NO: 1720 - protein, 121 aa, Homo sapiens
EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATNSEGYWWKDFQHWGPGTLVTVSS

SEQ ID NO: 1721 - protein, 121 aa, Homo sapiens
EVQLVQSGAEVKKPGASVKVSCKVSGYTLSELSIHWVRQAPGKGLEWMGGFDPEEGEIIYAQKFQGRVTMTEDTSTDTAYMELSSLRSEDTAVYYCATDSAGYWYKFFQHWGPGTLVTVSS

SEQ ID NO: 1722 - protein, 121 aa, Homo sapiens
EVQLVQSGAEVKKPGASVKVSCKVSGYTLTELSMHWVRQAPGKGLEWMGGFDPEAGETIYAQKFQGRVTMTEDTSTDTAYMELSSLRSEDTAVYYCATDGELYWYKFFQHWGPGTLVTVSS

SEQ ID NO: 1723 - protein, 121 aa, Homo sapiens
EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDAGGYWYKFFQHWGPGTLVTVSS

SEQ ID NO: 1724 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDAAGYWYKFFQHWGPGTLVTVSS

SEQ ID NO: 1725 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSAGFWYKFFQHWGPGTLVTVSS

SEQ ID NO: 1726 - protein, 121 aa, Homo sapiens
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSEGYWEKFFQHWGPGTLVTVSS

SEQ ID NO: 1727 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTVGRWEKYFQHWGPGTLVTVSS

SEQ ID NO: 1728 - protein, 121 aa, Homo sapiens
EVQLVQSGAEVKKPGASVKVSCKVSGYTLSELSVHWVRQAPGKGLEWMGGFDPEYGETIYAQKFQGRVTMTEDTSTDTAYMELSSLRSEDTAVYYCATDTMGYWEKYFQHWGPGTLVTVSS

SEQ ID NO: 1729 - protein, 121 aa, Homo sapiens
EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDSDGYWEKFFQHWGPGTLVTVSS

SEQ ID NO: 1730 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSYGYWEKFFQHWGPGTLVTVSS

SEQ ID NO: 1731 - protein, 121 aa, Homo sapiens
EVQLVQSGAEVKKPGASVKVSCKVSGYTLTELSMHWVRQAPGKGLEWMGGFDPENGETIYAQKFQGRVTMTEDTSTDTAYMELSSLRSEDTAVYYCATDTAGYWEKFFQHWGPGTLVTVSS

SEQ ID NO: 1732 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGVWEKYFQHWGPGTLVTVSS

SEQ ID NO: 1733 - protein, 121 aa, Homo sapiens
EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDSDGFWEKFFQHWGPGTLVTVSS

SEQ ID NO: 1734 - protein, 121 aa, Homo sapiens
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSVGYWEKFFQHWGPGTLVTVSS

SEQ ID NO: 1735 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTVGYWEKFFQHWGPGTLVTVSS

SEQ ID NO: 1736 - protein, 121 aa, Homo sapiens
EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSVGYWEKFFQHWGPGTLVTVSS

SEQ ID NO: 1737 - protein, 121 aa, Homo sapiens
EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDTVGNWEKFFQHWGPGTLVTVSS

SEQ ID NO: 1738 - protein, 121 aa, Homo sapiens
EVQLVQSGAEVKKPGASVKVSCKVSGYTLSELSMHWVRQAPGKGLEWMGGFDPEDGELIYAQKFQGRVTMTEDTSTDTAYMELSSLRSEDTAVYYCATDTDGYWEKYFQHWGPGTLVTVSS

SEQ ID NO: 1739 - protein, 121 aa, Homo sapiens
EVQLVQSGAEVKKPGASVKVSCKVSGYTLSELSMHWVRQAPGKGLEWMGGFDPEYGETIYAQKFQGRVTMTEDTSTDTAYMELSSLRSEDTAVYYCATDSDGYWEKYFQHWGPGTLVTVSS

SEQ ID NO: 1740 - protein, 121 aa, Homo sapiens
EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDSDSYWEKFFQHWGPGTLVTVSS

SEQ ID NO: 1741 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSDGYWEKFFQHWGPGTLVTVSS

SEQ ID NO: 1742 - protein, 121 aa, Homo sapiens
EVQLVQSGAEVKKPGASVKVSCKVSGYTLSGLSMHWVRQAPGKGLEWMGGFDPEEGETIYAQKFQGRVTMTEDTSTDTAYMELSSLRSEDTAVYYCATDSWGYWEKFFQHWGPGTLVTVSS

SEQ ID NO: 1743 - protein, 121 aa, Homo sapiens
EVQLVQSGAEVKKPGASVKVSCKVSGYTLSELSVHWVRQAPGKGLEWMGGFDPEEGETIYAQKFQGRVTMTEDTSTDTAYMELSSLRSEDTAVYYCATDSAGSWYKFFQHWGPGTLVTVSS

SEQ ID NO: 1744 - protein, 121 aa, Homo sapiens
EVQLVQSGAEVKKPGASVKVSCKVSGYTLSELSVHWVRQAPGKGLEWMGGFDPENGEIIYAQKFQGRVTMTEDTSTDTAYMELSSLRSEDTAVYYCATDSDGFWEKFFQHWGPGTLVTVSS

SEQ ID NO: 1745 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSQGYWYKFFQHWGPGTLVTVSS

SEQ ID NO: 1746 - protein, 121 aa, Homo sapiens
EVQLVQSGAEVKKPGASVKVSCKVSGYTLSELSMHWVRQAPGKGLEWMGGFDPEQGETIYAQKFQGRVTMTEDTSTDTAYMELSSLRSEDTAVYYCATDADGYWEKFFQHWGPGTLVTVSS

SEQ ID NO: 1747 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSVGRWYKFFQHWGPGTLVTVSS

SEQ ID NO: 1748 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTEGYWFKYFQHWGPGTLVTVSS

SEQ ID NO: 1749 - protein, 121 aa, Homo sapiens
EVQLVQSGAEVKKPGASVKVSCKVSGYTLSELSMHWVRQAPGKGLEWMGGFDPEEGEMIYAQKFQGRVTMTEDTSTDTAYMELSSLRSEDTAVYYCATESEGFWFKYFQHWGPGTLVTVSS

SEQ ID NO: 1750 - protein, 121 aa, Homo sapiens
EVQLVQSGAEVKKPGASVKVSCKVSGYTLTELSMHWVRQAPGKGLEWMGGFDPEYGETIYAQKFQGRVTMTEDTSTDTAYMELSSLRSEDTAVYYCATDSVSYWEKYFQHWGPGTLVTVSS

SEQ ID NO: 1751 - protein, 121 aa, Homo sapiens
EVQLVQSGAEVKKPGASVKVSCKVSGYTLSELSMHWVRQAPGKGLEWMGGFDPENGETIYAQKFQGRVTMTEDTSTDTAYMELSSLRSEDTAVYYCATDSDGYWEKFFQHWGPGTLVTVSS

SEQ ID NO: 1752 - protein, 121 aa, Homo sapiens
EVQLVQSGAEVKKPGASVKVSCKVSGYTLSELSMHWVRQAPGKGLEWMGGFDPEDGELIYAQKFQGRVTMTEDTSTDTAYMELSSLRSEDTAVYYCATDTEGYWEKYFQHWGPGTLVTVSS

SEQ ID NO: 1753 - protein, 121 aa, Homo sapiens
EVQLVQSGAEVKKPGASVKVSCKVSGYTLSELSLHWVRQAPGKGLEWMGGFNPEDGETIYAQKFQGRVTMTEDTSTDTAYMELSSLRSEDTAVYYCATDSEGYWVKYFQHWGPGTLVTVSS

SEQ ID NO: 1754 - protein, 121 aa, Homo sapiens
EVQLVQSGAEVKKPGASVKVSCKVSGYTLSELSMHWVRQAPGKGLEWMGGFDPENGETIYAQKFQGRVTMTEDTSTDTAYMELSSLRSEDTAVYYCATDSEGYWEKFFQHWGPGTLVTVSS

SEQ ID NO: 1755 - protein, 121 aa, Homo sapiens
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSDGYWEKFFQHWGPGTLVTVSS

SEQ ID NO: 1756 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTLGYWEKFFQHWGPGTLVTVSS

SEQ ID NO: 1757 - protein, 121 aa, Homo sapiens
EVQLVQSGAEVKKPGASVKVSCKVSGYTLSELSMHWVRQAPGKGLEWMGGFDPEDGENIYAQKFQGRVTMTEDTSTDTAYMELSSLRSEDTAVYYCATDSDGYWFKYFQHWGPGTLVTVSS

SEQ ID NO: 1758 - protein, 121 aa, Homo sapiens
EVQLVQSGAEVKKPGASVKVSCKVSGYTLSELSMHWVRQAPGKGLEWMGGFDPEEGEMIYAQKFQGRVTMTEDTSTDTAYMELSSLRSEDTAVYYCATDSDGYWEKFFQHWGPGTLVTVSS

SEQ ID NO: 1759 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSNGYWEKFFQHWGPGTLVTVSS

SEQ ID NO: 1760 - protein, 121 aa, Homo sapiens
EVQLVQSGAEVKKPGASVKVSCKVSGYTLSGLSMHWVRQAPGKGLEWMGGFDPEDGETIYAQKFQGRVTMTEDTSTDTAYMELSSLRSEDTAVYYCATDSEGYWEKFFQHWGPGTLVTVSS

SEQ ID NO: 1761 - protein, 121 aa, Homo sapiens
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSAGYWYQFFQHWGPGTLVTVSS

SEQ ID NO: 1762 - protein, 121 aa, Homo sapiens
EVQLVQSGAEVKKPGASVKVSCKVSGYTLSELSMHWVRQAPGKGLEWMGGFDPEVGEIIYAQKFQGRVTMTEDTSTDTAYMELSSLRSEDTAVYYCATDSEGFWFKYFQHWGPGTLVTVSS

SEQ ID NO: 1763 - protein, 121 aa, Homo sapiens
EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDTDGYWEKFFQHWGPGTLVTVSS

SEQ ID NO: 1764 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSEGYWEKFFQHWGPGTLVTVSS

SEQ ID NO: 1765 - protein, 121 aa, Homo sapiens
EVQLVQSGAEVKKPGASVKVSCKVSGYTLSELSLHWVRQAPGKGLEWMGGFDPEAGETIYAQKFQGRVTMTEDTSTDTAYMELSSLRSEDTAVYYCATDSAGFWYKYFQHWGPGTLVTVSS

SEQ ID NO: 1766 - protein, 121 aa, Homo sapiens
EVQLVQSGAEVKKPGASVKVSCKVSGYTLSELSMHWVRQAPGKGLEWMGGFDPEAGENIYAQKFQGRVTMTEDTSTDTAYMELSSLRSEDTAVYYCATDSEGYWVKFFQHWGPGTLVTVSS

SEQ ID NO: 1767 - protein, 121 aa, Homo sapiens
EVQLVQSGAEVKKPGASVKVSCKVSGYTLSELSMHWVRQAPGKGLEWMGGFDPEVGELIYAQKFQGRVTMTEDTSTDTAYMELSSLRSEDTAVYYCATDTDGYWEKYFQHWGPGTLVTVSS

SEQ ID NO: 1768 - protein, 121 aa, Homo sapiens
EVQLVQSGAEVKKPGASVKVSCKVSGYTLSELSMHWVRQAPGKGLEWMGGFDPEAGETIYAQKFQGRVTMTEDTSTDTAYMELSSLRSEDTAVYYCATDSEGYWYKFFQHWGPGTLVTVSS

SEQ ID NO: 1769 - protein, 121 aa, Homo sapiens
EVQLVQSGAEVKKPGASVKVSCKVSGYTLSELSMHWVRQAPGKGLEWMGGFDPEGGENIYAQKFQGRVTMTEDTSTDTAYMELSSLRSEDTAVYYCATDSDGYWEKFFQHWGPGTLVTVSS

SEQ ID NO: 1770 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGYWYKFFQHWGPGTLVTVSS

SEQ ID NO: 1771 - protein, 121 aa, Homo sapiens
EVQLVQSGAEVKKPGASVKVSCKVSGYTLSELSVHWVRQAPGKGLEWMGGFDPEEGETIYAQKFQGRVTMTEDTSTDTAYMELSSLRSEDTAVYYCATDSDGYWEKFFQHWGPGTLVTVSS

SEQ ID NO: 1772 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTVGNWEKFFQHWGPGTLVTVSS

SEQ ID NO: 1773 - protein, 121 aa, Homo sapiens
EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSEGYWEKFFQHWGPGTLVTVSS

SEQ ID NO: 1774 - protein, 121 aa, Homo sapiens
EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSDGYWEKFFQHWGPGTLVTVSS

SEQ ID NO: 1775 - protein, 121 aa, Homo sapiens
EVQLVQSGAEVKKPGASVKVSCKVSGYTLSELSLHWVRQAPGKGLEWMGGFDPEHGETIYAQKFQGRVTMTEDTSTDTAYMELSSLRSEDTAVYYCATDSLGYWYKFFQHWGPGTLVTVSS

SEQ ID NO: 1776 - protein, 121 aa, Homo sapiens
EVQLVQSGAEVKKPGASVKVSCKVSGYTLSELSMHWVRQAPGKGLEWMGGFDPEYGEIIYAQKFQGRVTMTEDTSTDTAYMELSSLRSEDTAVYYCATDSAGYWEKYFQHWGPGTLVTVSS

SEQ ID NO: 1777 - protein, 121 aa, Homo sapiens
EVQLVQSGAEVKKPGASVKVSCKVSGYTLSELSMHWVRQAPGKGLEWMGGFDPEDGEMIYAQKFQGRVTMTEDTSTDTAYMELSSLRSEDTAVYYCATDSEGYWEKYFQHWGPGTLVTVSS

SEQ ID NO: 1778 - protein, 121 aa, Homo sapiens
EVQLVQSGAEVKKPGASVKVSCKVSGYTLSELSVHWVRQAPGKGLEWMGGFDPEAGEIIYAQKFQGRVTMTEDTSTDTAYMELSSLRSEDTAVYYCATDSAGYWYKYFQHWGPGTLVTVSS

SEQ ID NO: 1779 - protein, 121 aa, Homo sapiens
EVQLVQSGAEVKKPGASVKVSCKVSGYTLTELSMHWVRQAPGKGLEWMGGFDPEEGETIYAQKFQGRVTMTEDTSTDTAYMELSSLRSEDTAVYYCATDSEGYWEKFFQHWGPGTLVTVSS

SEQ ID NO: 1780 - protein, 121 aa, Homo sapiens
EVQLVQSGAEVKKPGASVKVSCKVSGYTLSELSLHWVRQAPGKGLEWMGGSDPEEGETIYAQKFQGRVTMTEDTSTDTAYMELSSLRSEDTAVYYCATDSAGYWFKYFQHWGPGTLVTVSS

SEQ ID NO: 1781 - protein, 121 aa, Homo sapiens
EVQLVQSGAEVKKPGASVKVSCKVSGYTLTELSMHWVRQAPGKGLEWMGGFDPEVGEIIYAQKFQGRVTMTEDTSTDTAYMELSSLRSEDTAVYYCATDSAGYWYKYFQHWGPGTLVTVSS

SEQ ID NO: 1782 - protein, 121 aa, Homo sapiens
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSEGPWYKFFQHWGPGTLVTVSS

SEQ ID NO: 1783 - protein, 121 aa, Homo sapiens
EVQLVQSGAEVKKPGASVKVSCKVSGYTLTELSMHWVRQAPGKGLEWMGGFDPERGETIYAQKFQGRVTMTEDTSTDTAYMELSSLRSEDTAVYYCATDSAGYWYKFFQHWGPGTLVTVSS

SEQ ID NO: 1784 - protein, 121 aa, Homo sapiens
EVQLVQSGAEVKKPGASVKVSCKVSGYTLSELSMHWVRQAPGKGLEWMGGFDPEDGELIYAQKFQGRVTMTEDTSTDTAYMELSSLRSEDTAVYYCATDSEGFWFKYFQHWGPGTLVTVSS

SEQ ID NO: 1785 - protein, 121 aa, Homo sapiens
EVQLVQSGAEVKKPGASVKVSCKVSGYTLSELSMHWVRQAPGKGLEWMGGFDPEDGEMIYAQKFQGRVTMTEDTSTDTAYMELSSLRSEDTAVYYCATDSDGYWEKFFQHWGPGTLVTVSS

SEQ ID NO: 1786 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSAGYWYKFFQHWGPGTLVTVSS

SEQ ID NO: 1787 - protein, 121 aa, Homo sapiens
EVQLVQSGAEVKKPGASVKVSCKVSGYTLTELSMHWVRQAPGKGLEWMGGFDPEEGETIYAQKFQGRVTMTEDTSTDTAYMELSSLRSEDTAVYYCATDSDGYWEKFFQHWGPGTLVTVSS

SEQ ID NO: 1788 - protein, 121 aa, Homo sapiens
EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDTVGYWEKFFQHWGPGTLVTVSS

SEQ ID NO: 1789 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGYWEKFFQHWGPGTLVTVSS

SEQ ID NO: 1790 - protein, 121 aa, Homo sapiens
EVQLVQSGAEVKKPGASVKVSCKVSGYTLSELSMHWVRQAPGKGLEWMGGFDPEFGETIYAQKFQGRVTMTEDTSTDTAYMELSSLRSEDTAVYYCATDTDGYWEKFFQHWGPGTLVTVSS

SEQ ID NO: 1791 - protein, 121 aa, Homo sapiens
EVQLVQSGAEVKKPGASVKVSCKVSGYTLSELSMHWVRQAPGKGLEWMGGFDPEYGELIYAQKFQGRVTMTEDTSTDTAYMELSSLRSEDTAVYYCATDSDGYWEKYFQHWGPGTLVTVSS

SEQ ID NO: 1792 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSDGIWEKFFQHWGPGTLVTVSS

SEQ ID NO: 1793 - protein, 121 aa, Homo sapiens
EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDSDGYWEKFFQHWGPGTLVTVSS

SEQ ID NO: 1794 - protein, 121 aa, Homo sapiens
EVQLVQSGAEVKKPGASVKVSCKVSGYTLSELSMHWVRQAPGKGLEWMGGFDPEAGEIIYAQKFQGRVTMTEDTSTDTAYMELSSLRSEDTAVYYCATDSAGYWYKYFQHWGPGTLVTVSS

SEQ ID NO: 1795 - protein, 121 aa, Homo sapiens
EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDTDGYWEKFFQHWGQGTLVTVSS

SEQ ID NO: 1796 - protein, 121 aa, Homo sapiens
EVQLVQSGAEVKKPGASVKVSCKVSGYTLSELSMHWVRQAPGKGLEWMGGFDPEEGEIIYAQKFQGRVTMTEDTSTDTAYMELSSLRSEDTAVYYCATDTVGYWEKFFQHWGQGTLVTVSS

SEQ ID NO: 1797 - protein, 121 aa, Homo sapiens
EVQLVQSGAEVKKPGASVKVSCKVSGYTLSELSMHWVRQAPGKGLEWMGGFDPEYGELIYAQKFQGRVTMTEDTSTDTAYMELSSLRSEDTAVYYCATDTDGYWEKYFQHWGQGTLVTVSS

SEQ ID NO: 1798 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDAGGYWYKFFQHWGQGTLVTVSS

SEQ ID NO: 1799 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSAGYWYKFFQHWGQGTLVTVSS

SEQ ID NO: 1800 - protein, 121 aa, Homo sapiens
EVQLVQSGAEVKKPGASVKVSCKVSGYTLTELSMHWVRQAPGKGLEWMGGFDPEAGETIYAQKFQGRVTMTEDTSTDTAYMELSSLRSEDTAVYYCATDGELYWYKFFQHWGQGTLVTVSS

SEQ ID NO: 1801 - protein, 121 aa, Homo sapiens
EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDTEGYWEKFFQHWGQGTLVTVSS

SEQ ID NO: 1802 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSDGYWEKFFQHWGQGTLVTVSS

SEQ ID NO: 1803 - protein, 121 aa, Homo sapiens
EVQLVQSGAEVKKPGASVKVSCKVSGYTLTELSMHWVRQAPGKGLEWMGGFDPEHGETIYAQKFQGRVTMTEDTSTDTAYMELSSLRSEDTAVYYCATDSVSFWEKFFQHWGQGTLVTVSS

SEQ ID NO: 1804 - protein, 121 aa, Homo sapiens
EVQLVQSGAEVKKPGASVKVSCKVSGYTLSELSTHWVRQAPGKGLEWMGGFDPEYGEIIYAQKFQGRVTMTEDTSTDTAYMELSSLRSEDTAVYYCATDTVGNWYKFFQHWGQGTLVTVSS

SEQ ID NO: 1805 - protein, 121 aa, Homo sapiens
EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDTQGYWEKFFQHWGQGTLVTVSS

SEQ ID NO: 1806 - protein, 121 aa, Homo sapiens; identical to SEQ ID NO: 644

SEQ ID NO: 1807 - protein, 121 aa, Homo sapiens; identical to SEQ ID NO: 764

SEQ ID NO: 1808 - protein, 121 aa, Homo sapiens
EVQLVQSGAEVKKPGASVKVSCKVSGYTLSELSMHWVRQAPGKGLEWMGGFDPEVGELIYAQKFQGRVTMTEDTSTDTAYMELSSLRSEDTAVYYCATDTDGYWEKFFQHWGQGTLVTVSS

SEQ ID NO: 1809 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTAGNWYKFFQHWGQGTLVTVSS

SEQ ID NO: 1810 - protein, 121 aa, Homo sapiens; identical to SEQ ID NO: 704

SEQ ID NO: 1811 - protein, 121 aa, Homo sapiens
EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDTDGYWEKFFQHWGQGTLVTVSS

SEQ ID NO: 1812 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGYWEKFFQHWGQGTLVTVSS

SEQ ID NO: 1813 - protein, 121 aa, Homo sapiens
EVQLVQSGAEVKKPGASVKVSCKVSGYTLSELSLHWVRQAPGKGLEWMGGFDPEDGETIYAQKFQGRVTMTEDTSTDTAYMELSSLRSEDTAVYYCATDSLGYWYKFFQHWGQGTLVTVSS

SEQ ID NO: 1814 - protein, 121 aa, Homo sapiens
EVQLVQSGAEVKKPGASVKVSCKVSGYTLTELSMHWVRQAPGKGLEWMGGFDPEEGETIYAQKFQGRVNMTEDTSTDTAYMELSSLRSEDTAVYYCATNSEGYWWKDFQHWGQGTLVTVSS

SEQ ID NO: 1815 - protein, 121 aa, Homo sapiens
EVQLVQSGAEVKKPGASVKVSCKVSGYTLSELSMHWVRQAPGKGLEWMGGFDPEGGEIIYAQKFQGRVTMTEDTSTDTAYMELSSLRSEDTAVYYCATNSDGYWWKDFQHWGQGTLVTVSS

SEQ ID NO: 1816 - protein, 121 aa, Homo sapiens
EVQLVQSGAEVKKPGASVKVSCKVSGYTLSELSMHWVRQAPGKGLEWMGGFDPENGETIYAQKFQGRVTMTEDTSTDTAYMELSSLRSEDTAVYYCATDSDGYWEKFFQHWGQGTLVTVSS

SEQ ID NO: 1817 - protein, 121 aa, Homo sapiens
EVQLVQSGAEVKKPGASVKVSCKVSGYTLTELSMHWVRQAPGKGLEWMGGFDPEGGETIYAQKFQGRVTMTEDTSTDTAYMELSSLRSEDTAVYYCATDSGGYWYKFFQHWGQGTLVTVSS

SEQ ID NO: 1818 - protein, 121 aa, Homo sapiens
EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDSDGYWEKFFQHWGQGTLVTVSS

SEQ ID NO: 1819 - protein, 121 aa, Homo sapiens
EVQLVQSGAEVKKPGASVKVSCKVSGYTLSELSMHWVRQAPGKGLEWMGGFDPEGGELIYAQKFQGRVTMTEDTSTDTAYMELSSLRSEDTAVYYCATDSEGYWEKFFQHWGQGTLVTVSS

SEQ ID NO: 1820 - protein, 121 aa, Homo sapiens
EVQLVQSGAEVKKPGASVKVSCKVSGYTLTELSMHWVRQAPGKGLEWMGGFDPEGGETIYAQKFQGRVTMTEDTSTDTAYMELSSLRSEDTAVYYCATDSDGYWEKFFQHWGQGTLVTVSS

SEQ ID NO: 1821 - protein, 121 aa, Homo sapiens
EVQLVQSGAEVKKPGASVKVSCKVSGYSLSELSMHWVRQAPGKGLEWMGGFDPEVGEIIYAQKFQGRVTMTEDTSTDTAYMELSSLRSEDTAVYYCATDSAGYWYKYFQHWGQGTLVTVSS

SEQ ID NO: 1822 - protein, 121 aa, Homo sapiens
EVQLVQSGAEVKKPGASVKVSCKVSGYTLSELSMHWVRQAPGKGLEWMGGFDPENGETIYAQKFQGRVTMTEDTSTDTAYMELSSLRSEDTAVYYCATDTEGYWEKFFQHWGQGTLVTVSS

SEQ ID NO: 1823 - protein, 121 aa, Homo sapiens
EVQLVQSGAEVKKPGASVKVSCKVSGYTLSELSMHWVRQAPGKGLEWMGGFDPEEGEIIYAQKFQGRVTMTEDTSTDTAYMELSSLRSEDTAVYYCATDSVGYWEKFFQHWGQGTLVTVSS

SEQ ID NO: 1824 - protein, 121 aa, Homo sapiens
EVQLVQSGAEVKKHGASVKVSCKVSGYTLSELSMHWVRQAPGKGLEWMGGFDPEDGEIIYAQKFQGRVTMTEDTSTDTAYMELSSLRSEDTAVYYCATDSEGYWEKFFQHWGQGTLVTVSS

SEQ ID NO: 1825 - protein, 121 aa, Homo sapiens
EVQLVQSGAEVKKPGASVKVSCKVSGYTLSELSMHWVRQAPGKGLEWMGGFDPEEGETIYAQKFQGRVTMTEDTSTDTAYMELSSLRSEDTAMYYCATDSDGYWEKFFQHWGPGTLVTVSS

SEQ ID NO: 1826 - protein, 121 aa, Homo sapiens
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSDGYWEKFFQHWGQGTLVTVSS

SEQ ID NO: 1827 - protein, 121 aa, Homo sapiens
EVQLVQSGAEVKKPGASVKVSCKVSGYTLSELSVHWVRQAPGKGLEWMGGFDPEDGEVIYAQKFQGRVTMTEDTSTDTAYMELSSLRSEDTAVYYCATDSAGYWYKFFQHWGQGTLVTVSS

SEQ ID NO: 1828 - protein, 121 aa, Homo sapiens
EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDSEGYWEKFFQHWGQGTLVTVSS

SEQ ID NO: 1829 - protein, 121 aa, Homo sapiens
EVQLVQSGAEVKKPGASVKVSCKVSGYTLTELSMHWVRQAPGKGLEWMGGFDPEEGETIYAQKFQGRVTMTEDTSTDTAYMELSSLRSEDTAVYYCATDSDGYWEKFFQHWGQGTLVTVSS

SEQ ID NO: 1830 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATNSDGYWEKYFQHWGQGTLVTVSS

SEQ ID NO: 1831 - protein, 121 aa, Homo sapiens
EVQLVQSGAEVKKPGASVKVSCKVSGYTLSELSMHWVRQAPGKGLEWMGGFDPEAGETIYAQKFQGRVTMTEDTSTDTAYMELSSLRSEDTAVYYCATDSDGYWEKFFQHWGQGTLVTVSS

SEQ ID NO: 1832 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTEGYWEKFFQHWGQGTLVTVSS

SEQ ID NO: 1833 - protein, 121 aa, Homo sapiens
EVQLVQSGAEVKKPGASVKVSCKVSGYTLSELSIHWVRQAPGKGLEWMGGFDPEEGEIIYAQKFQGRVTMTEDTSTDTAYMELSSLRSEDTAVYYCATDSAGYWYKFFQHWGQGTLVTVSS

SEQ ID NO: 1834 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDTDGYWEKFFQHWGQGTLVTVSS

SEQ ID NO: 1835 - protein, 121 aa, Homo sapiens
EVQLVQSGAEVKKPGASVKVSCKVSGYTLSELSMHWVRQAPGKGLEWMGGFDPEDGETIYAQKFEGRVTMTEDTSTDTAYMELSSLRSEDTAVYYCATDSDGYWEKFFQHWGQGTLVTVSS

SEQ ID NO: 1836 - protein, 121 aa, Homo sapiens
EVQLVQSGAEVKKPGASVKVSCKVSGYTLTELSMHWVRQAPGKGLEWMGGFDPEDGEIIYAQKFQGRVTMTEDTSTDTAYMELSSLRSEDTAVYYCATDSEGYWEKFFQHWGQGTLVTVSS

SEQ ID NO: 1837 - protein, 121 aa, Homo sapiens
EVQLVQSGAEVKKPGASVKVSCKVSGYTLSELSMHWVRQAPGKGLEWMGGFDPEYGETIYAQKFQGRVTMTEDTSTDTAYMELSSLRSEDTAVYYCATDSDGYWEKFFQHWGQGTLVTVSS

SEQ ID NO: 1838 - protein, 121 aa, Homo sapiens
EVQLVQSGAEVKKPGASVKVSCKVSGYTLSELSMHWVRQAPGKGLEWMGGFDPEAGETIYAQKFQGRVTMTEDTSTDTAYMELSSLRSEDTAVYYCATDSEGYWEKFFQHWGQGTLVTVSS

SEQ ID NO: 1839 - protein, 121 aa, Homo sapiens
EVQLVQSGAEVKKPGASVKVSCKVSGYTLSELSMHWVRQAPGKGLEWMGGFDPEDGELIYAQKFQGRVTMTEDTSTDTAYMELSSLGSEDTAVYYCATNSAGYWWKDFQHWGQGTLVTVSS

SEQ ID NO: 1840 - protein, 121 aa, Homo sapiens
EVQLVQSGAEVKKPGASVKVSCKVSGYTLSELSVHWVRQAPGKGLEWMGGFDPENGEIIYAQKFQGRVTMTEDTSTDTAYMELSSLRSEDTAVYYCATDSDGFWEKFFQHWGQGTLVTVSS

SEQ ID NO: 1841 - protein, 121 aa, Homo sapiens
EVQLVQSGAEVKKPGASVKVSCKVSGYTLTELSMHWVRQAPGKGLEWMGGFDPEEGELIYAQKFQGRVTMTEDTSTDTAYMELSSLRSEDTAVYYCATDSDGYWEKFFQHWGQGTLVTVSS

SEQ ID NO: 1842 - protein, 121 aa, Homo sapiens
EVQLVQSGAEVMKPGASVKVSCKVSGYTLTELSMHWVRQAPGKGLEWMGGFDPEYGETIYAQKFQGRVTMTEDTSTDTAYMELSSLRSEDTAVYYCATDTVGYWEKFFQHWARGTLVTVSS

SEQ ID NO: 1843 - protein, 121 aa, Homo sapiens
EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSDGYWEKFFQHWGQGTLVTVSS

SEQ ID NO: 1844 - protein, 121 aa, Homo sapiens
EVQLVQSGAEVKKPGASVKVSCKVSGYTLTELSMHWVRQAPGKGLEWMGGFDPEVGETIYAQKFQGRVTMTEDTSTDTAYMELSSLRSEDTAVYYCATDSDGYWEKFFQHWGQGTLVTVSS

SEQ ID NO: 1845 - protein, 121 aa, Homo sapiens
EVQLVQSGAEVKKPGASVKVSCKVSGYTISELSMHWVRQAPGKGLEWMGGFDPEVGEIIYAQKFQGRVTMTEDTSTDTAYMELSSLRSEDTAVYYCATDSEGYWEKFFQHWGQGTLVTVSS

SEQ ID NO: 1846 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDSDGFWEKFFQHWGQGTLVTVSS

SEQ ID NO: 1847 - protein, 121 aa, Homo sapiens
EVQLVQSGAEVKKPGASVKVSCKVSGYTLSELSVHWVRQAPGKGLEWMGGFDPEDGEIIYAQKFQGRVTMTEDTSTDTAYMELSSLRSEDTAVYYCATDTDGYWEKFFQHWGQGTLVTVSS

SEQ ID NO: 1848 - protein, 121 aa, Homo sapiens
EVQLVQSGAEVKKPGASVKVSCKVSGYTLTELSMHWVRQAPGKGLEWMGGFDPEVGETIYAQKFQGRVTMTEDTSTDTAYMELSSLRSEDTAVYYCATDSAGFWYKFFQHWGQGTLVTVSS

SEQ ID NO: 1849 - protein, 121 aa, Homo sapiens
EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDSDGYWEKFFQHWGQGTLVTVSS

SEQ ID NO: 1850 - protein, 121 aa, Homo sapiens
EVQLVQSGAEVKKPGASVKVSCKVSGYTLSELSIHWVRQAPGKGLEWMGGFDPENGEIIYAQKFQGRVTMTEDTSTDTAYMELSSLRSEDTAVYYCATDSDGYWEKFFQHWGQGTLVTVSS

SEQ ID NO: 1851 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSVGRWYKFFQHWGQGTLVTVSS

SEQ ID NO: 1852 - protein, 121 aa, Homo sapiens
EVQLVQSGAEVKKPGASVKVSCKVSGYTLTELSMHWVRQAPGKGLEWMGGFDPEYGETIYAQKFQGRVTMTEDTSTDTAYMELSSLRSEDTAVYYCATDTVGYWEKFFQHWGQGTLVTVSS

SEQ ID NO: 1853 - protein, 121 aa, Homo sapiens
EVQLVQSGAEVKKPGASVKVSCKVSGYTLTELSMHWVRQAPGKGLEWMGGFDPEVGEIIYAQKFQGRVTMTEDTSTDTAYMELSSLRSEDTAVYYCATDSDGYWEKFFQHWGQGTLVTVSS

SEQ ID NO: 1854 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDTDGYWEKFFQHWGQGTLVTVSS

SEQ ID NO: 1855 - protein, 121 aa, Homo sapiens
EVQLVQSGAEVKKPGASVKVSCKVSGYTLTELSMHWVRQAPGKGLEWMGGFDPEVGETIYAQKFQGRVTMTEDTSTDTAYMELSSLRSEDTAVYYCATDSVGRWYKFFQHWGQGTLVTVSS

SEQ ID NO: 1856 - protein, 121 aa, Homo sapiens
EVQLVQSGAEVKKPGASVKVSCKVSGYTLTELSMHWVRQAPGKGLEWMGGFDPEYGEIIYAQKFQGRVTMTEDTSTDTAYMELSSLRSEDTAVYYCATDTEGYWEKFFQHWGQGTLVTVSS

SEQ ID NO: 1857 - protein, 121 aa, Homo sapiens
EVQLVQSGAEVKKPGASVKVSCKVSGYTLSELSVHWVRQAPGKGLEWMGGLDPEDGETIYAQKFQGRVTMTEDTSTDTAYMELSSLRSEDTAVYYCATESVGYWYKFFQHWGQGTLVTVSS

SEQ ID NO: 1858 - protein, 121 aa, Homo sapiens
EVQLVQSGAEVKKPGASVKVSCKVSGYTLTELSMHWVRQAPGKGLEWMGGFDPEGGETIYAQKFQGRVTMTEDTSTDTAYMELSSLRSEDTAVYYCATNSVGYWWKDFQHWGQGTLVTVSS

SEQ ID NO: 1859 - protein, 121 aa, Homo sapiens
EVQLVQSGAEVKKPGASVKVSCKVSGYTLSELSVHWVRQAPGKGLEWMGGFDPEYGETIYAQKFQGRVTMTEDTSTDTAYMELSSLRSEDTAVYYCATDTDGYWEKYFQHWGQGTLVTVSS

SEQ ID NO: 1860 - protein, 121 aa, Homo sapiens
EVQLVQSGAEVKKPGASVKVSCKVSGYTLSELSMHWVRQAPGKGLEWMGGFDPEEGETIYAQKFQGRVTMTEDTSTDTAYMELSSLRSEDTAVYYCATDSEGYWEKFFQHWGQGTLVTVSS

SEQ ID NO: 1861 - protein, 121 aa, Homo sapiens
EVQLVQSGAEVKKPGASVKVSCKVSGYTLSELSVHWVRQAPGKGLEWMGGFDPEAGEIIYAQKFQGRVTMTEDTSTDTAYMELSSLRSEDTAVYYCATDSAGYWYKYFQHWGQGTLVTVSS

SEQ ID NO: 1862 - protein, 121 aa, Homo sapiens
EVQLVQSGAEVKKPGASVKVSCKVSGYTLSELSMHWVRQAPGKGLEWMGGFDPEDGEIIYAQKFQGRVTMTEDTSTDTAYMELSSLRSEDTAVYYCATDSDGFWEKFFQHWGQGTLVTVSS

SEQ ID NO: 1863 - protein, 121 aa, Homo sapiens
EVQLVQSGAEVKKPGASVKVSCKVSGYTLSELSMHWVRQAPGKGLEWMGGFDPEVGETIYAQKFQGRVTMTEDTSTDTAYMELSSLRSEDTAVYYCATDSDGFWEKFFQHWGQGTLVTVSS

SEQ ID NO: 1864 - protein, 121 aa, Homo sapiens
EVQLVQSGAEVKKPGASVKVSCKVSGYTLSELSMHWVRQAPGKGLEWMGGFDPEGGETIYAQKFQGRVTMTEDTSTDTAYMELSSLRSEDTAVYYCATDAGGYWYKFFQHWGQGTLVTVSS

SEQ ID NO: 1865 - protein, 121 aa, Homo sapiens
EVQLVQSGAEVKKPGASVKVSCKVSGYTLSELSVHWVRQAPGKGLEWMGGFDPEDGETIYAQKFQGRVTMTEDTSTDTAYMELSSLRSEDTAVYYCATDTDGYWEKFFQHWGQGTLVTVSS

SEQ ID NO: 1866 - protein, 121 aa, Homo sapiens
EVQLVQSGAEVKKPGASVKVSCKVSGYTLSELSMHWVRQAPGKGLEWMGGFDPEDGETIYAQKFQGRVTMTEDTSTDTAYMELSSLRSEDTAVYYCATDAAGYWYKFFQHWGQGTLVTVSS

SEQ ID NO: 1867 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLFDGGTLVFGGGTKLTVL

SEQ ID NO: 1868 - protein, 109 aa, Homo sapiens
QAVVTQEPSLTVSPGGTVTLTCGLSTGNVTIWHYPYWFQQKPGQAPRTLIFDTNDKHSWTPARFSGSLLGGKAALTLSGAQPEDEAEYYCLLFYGGTVVFGGGTKLTVL

SEQ ID NO: 1869 - protein, 109 aa, Homo sapiens
QAVVTQEPSLTVSPGGTVTLTCGSSTGNVTIWHYPYWFQQKPGQAPRTLISDTNDKHSWTPARFSGSLLGGKAALTLSGAQPEDEAEYYCLLFYGGTVVFGGGTKLTVL

SEQ ID NO: 1870 - protein, 109 aa, Homo sapiens
QAVVTQEPSLTVSPGGTVTLTCGSSTGDVTIDHYPYWFQQKPGQAPRTLISDTDDKHSWTPARFSGSLLGGKAALTLSGAQPEDEAEYYCLLFYGGTLVFGGGTKLTVL

SEQ ID NO: 1871 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLFYGGTVVFGGGTKLTVL

SEQ ID NO: 1872 - protein, 109 aa, Homo sapiens
QAVVTQEPSLTVSPGGTVTLTCGSSTGDVTIDHYPYWFQQKPGQAPRTLISDTNDKHSWTPARFSGSLLGGKAALTLSGAQPEDEAEYYCLLFYGGTLVFGGGTKLTVL

SEQ ID NO: 1873 - protein, 109 aa, Homo sapiens
QAVVTQEPSLTVSPGGTVTLTCGSSTGPVTIDHYPYWFQQKPGQAPRTLISDTDDKHSWTPARFSGSLLGGKAALTLSGAQPEDEAEYYCLLFYGGTVVFGGGTKLTVL

SEQ ID NO: 1874 - protein, 109 aa, Homo sapiens
QAVVTQEPSLTVSPGGTVTLTCGSSTGNVTSGHYPYWFQQKPGQAPRTLISDTIDKHSWTPARFSGSLLGGKAALTLSGAQPEDEAEYYCLLFYGGTLVFGGGTKLTVL

SEQ ID NO: 1875 - protein, 109 aa, Homo sapiens
QAVVTQEPSLTVSPGGTVTLTCGSSTGGVTSEHYPYWFQQKPGQAPRTLISDTIDKHSWTPARFSGSLLGGKAALTLSGAQPEDEAEYYCLLFYGGTLVFGGGTKLTVL

SEQ ID NO: 1876 - protein, 109 aa, Homo sapiens
QAVVTQEPSLTVSPGGTVTLTCGSSTGAVTVNHYPYWFQQKPGQAPRTLISDTDDKHSWTPARFSGSLLGGKAALTLSGAQPEDEAEYYCLLFYGGTVVFGGGTKLTVL

SEQ ID NO: 1877 - protein, 109 aa, Homo sapiens
QAVVTQEPSLTVSPGGTVTLTCGSSTGNVTIEHYPYWFQQKPGQAPRTLISDTNDKHSWTPARFSGSLLGGKAALTLSGAQPEDEAEYYCLLFYGGTMVFGGGTKLTVL

SEQ ID NO: 1878 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLFNGGTLVFGGGTKLTVL

SEQ ID NO: 1879 - protein, 109 aa, Homo sapiens
QAVVTQEPSLTVSPGGTVTLTCGSSTGAVTIEHYPYWFQQKPGQAPRTLISDTNDKHSWTPARFSGSLLGGKAALTLSGAQPEDEAEYYCLLFYGGTVVFGGGTKLTVL

SEQ ID NO: 1880 - protein, 109 aa, Homo sapiens
QAVVTQEPSLTVSPGGTVTLTCGSSTGSVTSDHYPYWFQQKPGQAPRTLISDTNDKHSWTPARFSGSLLGGKAALTLSGAQPEDEAEYYCLLFYGGTLVFGGGTKLTVL

SEQ ID NO: 1881 - protein, 109 aa, Homo sapiens
QAVVTQEPSLTVSPGGTVTLTCGSSTGEVTIDHYPYWFQQKPGQAPRTLISDTNDKHSWTPARFSGSLLGGKAALTLSGAQPEDEAEYYCLLFYGGSVVFGGGTKLTVL

SEQ ID NO: 1882 - protein, 109 aa, Homo sapiens
QAVVTQEPSLTVSPGGTVTLTCGSSTGSVTIDHYPYWFQQKPGQAPRTLISDTNDKHSWTPARFSGSLLGGKAALTLSGAQPEDEAEYYCLLFYGGTVVFGGGTKLTVL

SEQ ID NO: 1883 - protein, 109 aa, Homo sapiens
QAVVTQEPSLTVSPGGTVTLTCGSSTGPVTSDHYPYWFQQKPGQAPRTLISDTIDKHSWTPARFSGSLLGGKAALTLSGAQPEDEAEYYCLLFYGGTVVFGGGTKLTVL

SEQ ID NO: 1884 - protein, 109 aa, Homo sapiens
QAVVTQEPSLTVSPGGTVTLTCGSSTGAVTIGHYPYWFQQKPGQAPRTLISDTDDKHSWTPARFSGSLLGGKAALTLSGAQPEDEAEYYCLLFYGGTLVFGGGTKLTVL

SEQ ID NO: 1885 - protein, 109 aa, Homo sapiens
QAVVTQEPSLTVSPGGTVTLTCGSSTGAVTSEHYPYWFQQKPGQAPRTLISDTNDKHSWTPARFSGSLLGGKAALTLSGAQPEDEAEYYCLLFYGGNLVFGGGTKLTVL

SEQ ID NO: 1886 - protein, 109 aa, Homo sapiens
QAVVTQEPSLTVSPGGTVTLTCGSSTGAVTIEHYPYWFQQKPGQAPRTLISDTDDKHSWTPARFSGSLLGGKAALTLSGAQPEDEAEYYCLLFYGGTVVFGGGTKLTVL

SEQ ID NO: 1887 - protein, 109 aa, Homo sapiens
QAVVTQEPSLTVSPGGTVTLTCGSSTGAVTSDHYPYWFQQKPGQAPRTLISDTNDKHSWTPARFSGSLLGGKAALTLSGAQPEDEAEYYCLLFYGGTLVFGGGTKLTVL

SEQ ID NO: 1888 - protein, 109 aa, Homo sapiens
QAVVTQEPSLTVSPGGTVTLTCGSSTGDVTIYHYPYWFQQKPGQAPRTFISDTRDKHSWTPARFSGSLLGGKAALTLSGAQPEDEAEYYCLLFYGGTVVFGGGTKLTVL

SEQ ID NO: 1889 - protein, 109 aa, Homo sapiens
QAVVTQEPSLTVSPGGTVTLTCGSSTGAVTSEHYPYWFQQKPGQAPRTLISDTDDKHSWTPARFSGSLLGGKAALTLSGAQPEDEAEYYCLLFYGGTLVFGGGTKLTVL

SEQ ID NO: 1890 - protein, 109 aa, Homo sapiens
QAVVTQEPSLTVSPGGTVTLTCGSSTGAVTSEHYPYWFQQKPGQAPRTLISDTNDKHSWTPARFSGSLLGGKAALTLSGAQPEDEAEYYCLLFYGGTLVFGGGTKLTVL

SEQ ID NO: 1891 - protein, 109 aa, Homo sapiens
QAVVTQEPSLTVSPGGTVTLTCGSSTGAVTSGHYPYWFQQKPGQAPRTLISDTDDKHSWTPARFSGSLLGGKAALTLSGAQPEDEAEYYCLLDYGGTFVFGGGTKLTVL

SEQ ID NO: 1892 - protein, 109 aa, Homo sapiens
QAVVTQEPSLTVSPGGTVTLTCGSSTGGVTIDHYPYWFQQKPGQAPRTLISDTNDKHSWTPARFSGSLLGGKAALTLSGAQPEDEAEYYCLLFYGGTLVFGGGTKLTVL

SEQ ID NO: 1893 - protein, 109 aa, Homo sapiens
QAVVTQEPSLTVSPGGTVTLTCGSSTGAVTIEHYPYWFQQKPGQAPRTLISDTDDKHSWTPARFSGSLLGGKAALTLSGAQPEDEAEYYCLLFYGGNVVFGGGTKLTVL

SEQ ID NO: 1894 - protein, 109 aa, Homo sapiens
QAVVTQEPSLTVSPGGTVTLTCGSSTGPVTIDHYPYWFQQKPGQAPRTLISDTNDKHSWTPARFSGSLLGGKAALTLSGAQPEDEAEYYCLLFYGGTLVFGGGTKLTVL

SEQ ID NO: 1895 - protein, 109 aa, Homo sapiens
QAVVTQEPSLTVSPGGTVTLTCGSSTGEVTIDHYPYWFQQKPGQAPRTLISDTNDKHSWTPARFSGSLLGGKAALTLSGAQPEDEAEYYCLLFYGGTVVFGGGTKLTVL

SEQ ID NO: 1896 - protein, 109 aa, Homo sapiens
QAVVTQEPSLTVSPGGTVTLTCGSSTGAVTIEHYPYWFQQKPGQAPRTLISDTNDKHSWTPARFSGSLLGGKAALTLSGAQPEDEAEYYCLLFYGGTLVFGGGTKLTVL

SEQ ID NO: 1897 - protein, 109 aa, Homo sapiens
QAVVTQEPSLTVSPGGTVTLTCGSSTGDVTIEHYPYWFQQKPGQAPRTLVSDTNDKHSWTPARFSGSLLGGKAALTLSGAQPEDEAEYYCLLFFGGTMVFGGGTKLTVL

SEQ ID NO: 1898 - protein, 109 aa, Homo sapiens
QAVVTQEPSLTVSPGGTVTLTCGSSTGDVTIDHYPYWFQQKPGQAPRTLISDTNDKHSWTPARFSGSLLGGKAALTLSGAQPEDEAEYYCLLDYGGSVVFGGGTKLTVL

SEQ ID NO: 1899 - protein, 109 aa, Homo sapiens
QAVVTQEPSLTVSPGGTVTLTCGSSTGAVTIEHYPYWFQQKPGQAPRTLISDTIDKHSWTPARFSGSLLGGKAALTLSGAQPEDEAEYYCLLFYGGTVVFGGGTKLTVL

SEQ ID NO: 1900 - protein, 109 aa, Homo sapiens
QAVVTQEPSLTVSPGGTVTLTCGSSTGDVTSGHYPYWFQQKPGQAPRTLISDTDDKHSWTPARFSGSLLGGKAALTLSGAQPEDEAEYYCLLFYGGTLVFGGGTKLTVL

SEQ ID NO: 1901 - protein, 109 aa, Homo sapiens
QAVVTQEPSLTVSPGGTVTLTCGSSTGSVTSGHYTYWFQQKPGQAPRTLISDTDDKHSWTPARFSGSLLGGKAALTLSGAQPEDEAEYYCLLFYGGRLVFGGGTKLTVL

SEQ ID NO: 1902 - protein, 109 aa, Homo sapiens
QAVVTQEPSLTVSPGGTVTLTCGSSTGPVTSEHYPYWFQQKPGQAPRTLISDTDDKHSWTPARFSGSLLGGKAALTLSGAQPEDEAEYYCLLFYGGTVVFGGGTNLTVL

SEQ ID NO: 1903 - protein, 109 aa, Homo sapiens
QAVVTQEPSLTVSPGGTVTLTCGSSTGAVTTEHYPYWFQQKPGQAPRTLISDTIDKHSWTPARFSGSLLGGKAALTLSGAQPEDEAEYYCLLFYGGTLVFGGGTKLTVL

SEQ ID NO: 1904 - protein, 109 aa, Homo sapiens
QAVVTQEPSLTVSPGGTVTLTCGSSTGEVTIGHYPYWFQQKPGQAPRTLISDTNDKHSWTPARFSGSLLGGKAALTLSGAQPEDEAEYYCLLFYGGTLVFGGGTKLTVL

SEQ ID NO: 1905 - protein, 109 aa, Homo sapiens
QAVVTQEPSLTVSPGGTVTLTCGSSTGSVTSEHYPYWFQQKPGQAPRTLISDTNDKHSWTPARFSGSLLGGKAALTLSGAQPEDEAEYYCLLFYGGTLVFGGGTKLTVL

SEQ ID NO: 1906 - protein, 109 aa, Homo sapiens
QAVVTQEPSLTVSPGGTVTLTCGSSTGAVTSDHYPYWFQQKPGQAPRTLISDTDDKHSWTPARFSGSLLGGKAALTLSGAQPEDEAEYYCLLFYGGTLVFGGGTKLTVL

SEQ ID NO: 1907 - protein, 109 aa, Homo sapiens
QAVVTQEPSLTVSPGGTVTLTCGSSTGAVTSEHYPYWFQQKPGQAPRTLISDTDDKHSWTPARFSGSLLGGKAALTLSGAQPEDEAEYYCLLFYGGNLVFGGGTKLTVL

SEQ ID NO: 1908 - protein, 109 aa, Homo sapiens
QAVVTQEPSLTVSPGGTVTLTCGSSTGEVTGDHYPYWFQQKPGQAPRTLISDTNDKHSWTPARFSGSLLGGKAALTLSGAQPEDEAEYYCLLFYGGTLVFGGGTKLTVL

SEQ ID NO: 1909 - protein, 109 aa, Homo sapiens
QAVVTQEPSLTVSPGGTVTLTCGSSTGAVTSDHYPYWFQQKPGQAPRTLISDTIDKHSWTPARFSGSLLGGKAALTLSGAQPEDEAEYYCLLFYGGTLVFGGGTKLTVL

SEQ ID NO: 1910 - protein, 109 aa, Homo sapiens
QAVVTQEPSLTVSPGGTVTLTCGSSTGGVTIDHYPYWFQQKPGQAPRTLISDTNDKHSWTPARFSGSLLGGKAALTLSGAQPEDEAEYYCLLFYGGSLVFGGGTKLTVL

SEQ ID NO: 1911 - protein, 109 aa, Homo sapiens
QAVVTQEPSLTVSPGGTVTLTCGSSTGPVTSEHYPYWFQQKPGQAPRTLISDTNDKHSWTPARFSGSLLGGKAALTLSGAQPEDEAEYYCLLFYGGTLVFGGGTKLTVL

SEQ ID NO: 1912 - protein, 109 aa, Homo sapiens
QAVVTQEPSLTVSPGGTVTLTCGSSTGPVTSEHYPYWFQQKPGQAPRTLISDTDDKHSWTPARFSGSLLGGKAALTLSGAQPEDEAEYYCLLFYGGTMVFGGGTKLTVL

SEQ ID NO: 1913 - protein, 109 aa, Homo sapiens
QAVVTQEPSLTVSPGGTVTLTCGSSTGPVTSEHYPYWFQQKPGQAPRTLISDTDDKHSWTPARFSGSLLGGKAALTLSGAQPEDEAEYYCLLFYGGTVVFGGGTKLTVL

SEQ ID NO: 1914 - protein, 109 aa, Homo sapiens
QAVVTQEPSLTVSPGGTVTLTCGSSTGGVTSEHYPYWFQQKPGQAPRTLIYDTIEKDSWTPARFSGSLLGGKAALTLSGAQPEDEAEYYCLLFYGGTLVFGGGTKLTVL

SEQ ID NO: 1915 - protein, 109 aa, Homo sapiens; identical to SEQ ID NO: 2

SEQ ID NO: 1916 - protein, 109 aa, Homo sapiens
QAVVTQEPSLTVSPGGTVTLTCGSSTGAVTSEHYPYWFQQKPGQAPRTLISDTDDKHSWTPARFSGSLLGGKAALTLSGAQPEDEAEYYCLLFYGGTVVFGGGTKLTVL

SEQ ID NO: 1917 - protein, 109 aa, Homo sapiens
QAVVTQEPSLTVSPGGTVTLTCGSSTGDVTIDHYPYWFQQKPGQAPRTLISDTNDKHSWTPARFSGSLLGGKAALTLSGAQPEDEAEYYCLLFYGGTVVFGGGTKLTVL

SEQ ID NO: 1918 - protein, 109 aa, Homo sapiens
QAVVTQEPSLTVSPGGTVTLTCGSSTGAVTIEHYPYWFQQKPGQAPRTLISDTNDKHSWTPARFSGSLLGGKAALTLSGAQPEDEAEYYCLLFYGGNVVFGGGTKLTVL

SEQ ID NO: 1919 - protein, 109 aa, Homo sapiens
QAVVTQEPSLTVSPGGTVTLTCGSSTGDVTIDHYPYWFQQKPGQAPRTLISDTDDKQSWTPARFSGSLLGGKAALTLSGAQPEDEAEYYCLLFYGGTVVFGGGTKLTVL

SEQ ID NO: 1920 - protein, 109 aa, Homo sapiens
QAVVTQEPSLTVSPGGTVTLTCGSSTGPVTIDHYPYWFQQKPGQAPRTLISDTNDKHSWTPARFSGSLLGGKAALTLSGAQPEDEAEYYCLLFYGGTVVFGGGTKLTVL

SEQ ID NO: 1921 - protein, 109 aa, Homo sapiens
QAVVTQEPSLTVSPGGTVTLTCGSSTGAVTIEHYPYWFQQKPGQAPRTLISDTNDKHSWTPARFSGSLLGGKAALTLSGAQPEDEAEYYCLLFFGGTVVFGGGTKLTVL

SEQ ID NO: 1922 - protein, 109 aa, Homo sapiens
QAVVTQEPSLTVSPGGTVTLTCGSSTGAVTIWHYPYWFQQKPGQAPRTLISDTNDKHSWTPARFSGSLLGGKAALTLSGAQPEDEAEYYCLLDDGSTVVFGGGTKLTVL

SEQ ID NO: 1923 - protein, 109 aa, Homo sapiens
QAVVTQEPSLTVSPGGTVTLTCGSSTGAVTSGHYPYWFQQKPGQAPRTLIYDTDDKNSWTPARFSGSLLGGKAALTLSGAQPEDEAEYYCLLDYGGTFVFGGGTKLTVL

SEQ ID NO: 1924 - protein, 109 aa, Homo sapiens
QAVVTQEPSLTVSPGGTVTLTCGSSTGAVTIWHYPYWFQQKPGQAPRTLISDTNDKHSWTPARFSGSLLGGKAALTLSGAQPEDEAEYYCLLFDGGTVVFGGGTKLTVL

SEQ ID NO: 1925 - protein, 109 aa, Homo sapiens
QAVVTQEPSLTVSPGGTVTLTCGSSTGGVTSGHYPYWFQQKPGQAPRTLISDTNDKHSWTPARFSGSLLGGKAALTLSGAQPEDEAEYYCLLFYGGTVVFGGGTKLTVL

SEQ ID NO: 1926 - protein, 109 aa, Homo sapiens
QAVVTQEPSLTVSPGGTVTLTCGSSTGDVTSEHYPYWFQQKPGQAPRTLISDTDDKHSWTPARFSGSLLGGKAALTLSGAQPEDEAEYYCLLFYGGTLVFGGGTKLTVL

SEQ ID NO: 1927 - protein, 109 aa, Homo sapiens
QAVVTQEPSLTVSPGGTVTLTCGSSTGNVTSEHYPYWFQQKPGQAPRTLISDTNDKHSWTPARFSGSLLGGKAALTLSGAQPEDEAEYYCLLFYGGTLVFGGGTKLTVL

SEQ ID NO: 1928 - protein, 109 aa, Homo sapiens
QAVVTQEPSLTVSPGGTVTLTCGSSTGDVTIGHYPYWFQQKPGQAPRTLISDTNDKHSWTPARFSGSLLGGKAALTLSGAQPEDEAEYYCLLFYGGTMVFGGGTKLTVL

SEQ ID NO: 1929 - protein, 109 aa, Homo sapiens
QAVVTQEPSLTVSPGGTVTLTCGSSTGGVTSEHYPYWFQQKPGQAPRTLISDTDDKHSWTPARFSGSLLGGKAALTLSGAQPEDEAEYYCLLFDGGTLVFGGGTKLTVL

SEQ ID NO: 1930 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLFYGGTLVFGGGTKLTVL

SEQ ID NO: 1931 - protein, 109 aa, Homo sapiens
QAVVTQEPSLTVSPGGTVTLTCGSSTGPVTIEHYPYWFQQKPGQAPRTLISDTNDKHSWTPARFSGSLLGGKAALTLSGAQPEDEAEYYCLLFYGGTVVFGGGTKLTVL

SEQ ID NO: 1932 - protein, 109 aa, Homo sapiens
QAVVTQEPSLTVSPGGTVTLTCGSSTGNVTSEHYPYWFQQKPGQAPRTLISDTNDKHSWTPARFSGSLLGGKAALTLSGAQPEDEAEYYCLLFYGGTVVFGGGTKLTVL

SEQ ID NO: 1933 - protein, 109 aa, Homo sapiens
QAVVTQEPSLTVSPGGTVTLTCGSSTGAVTIEHYPYWFQQKPGQAPRTLISDTNDKHSWTPARFSGSLLGGKAALTLSGAQPEDEAEYYCLLFYGGSMVFGGGTKLTVL

SEQ ID NO: 1934 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLFDRGSMVFGGGTKLTVL

SEQ ID NO: 1935 - protein, 109 aa, Homo sapiens
QAVVTQEPSLTVSPGGTVTLTCGSSTGTVTSEHYPYWFQQKPGQAPRTLISDTDDKHSWTPARFSGSLLGGKAALTLSGAQPEDEAEYYCLLFYGGTLVFGGGTKLTVL

SEQ ID NO: 1936 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLFYGGTVVFGGGTKLTVL

SEQ ID NO: 1937 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGTFVFGGGTKLTVL

SEQ ID NO: 1938 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYEGTFVFGGGTKLTVL

SEQ ID NO: 1939 - protein, 109 aa, Homo sapiens
QAVVTQEPSLTVSPGGTVTLTCGSSTGGVTIDHYPYWFQQKPGQAPRTLISDTDDKHSWTPARFSGSLLGGKAALTLSGAQPEDEAEYYCLLDYGGSFVFGGGTKLTVL

SEQ ID NO: 1940 - protein, 109 aa, Homo sapiens
QAVVTQEPSLTVSPGGTVTLTCGSSTGPVTIEHYPYWFQQKPGQAPRTLISDTDDKHSWTPARFSGSLLGGKAALTLSGAQPEDEAEYYCLLFYGGTVVFGGGTKLTVL

SEQ ID NO: 1941 - protein, 109 aa, Homo sapiens; identical to SEQ ID NO: 1871

SEQ ID NO: 1942 - protein, 109 aa, Homo sapiens
  MOD_RES (54)..(54): Any amino acid
QAVVTQEPSLTVSPGGTVTLTCGSSTGAVTIWHYPYWFQQKPGQAPRTLISDTXDKHSWTPARFSGSLLGGKAALTLSGAQPEDEAEYYCLLDYGGSFVFGGGTKLTVL

SEQ ID NO: 1943 - protein, 109 aa, Homo sapiens
QAVVTQEPSLTVSPGGTVTLTCGSSTGNVTIEHYPYWFQQKPGQAPRTLISDTDDKHSWTPARFSGSLLGGKAALTLSGAQPEDEAEYYCLLDYRGTFVFGGGTKLTVL

SEQ ID NO: 1944 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYRGTFVFGGGTKLTVL

SEQ ID NO: 1945 - protein, 109 aa, Homo sapiens
QAVVTQEPSLTVSPGGTVTLTCGSSTGSVTIDHYPYWFQQKPGQAPRTLISDTDDKHSWTPARFSGSLLGGKAALTLSGAQPEDEAEYYCLLDYGGSFVFGGGTKLTVL

SEQ ID NO: 1946 - protein, 109 aa, Homo sapiens
QAVVTQEPSLTVSPGGTVTLTCGSSTGPVTIDHYPYWFQQKPGQAPRTLISDTDDKHSWTPARFSGSLLGGKAALTLSGAQPEDEAEYYCLLDYGGSFVFGGGTKLTVL

SEQ ID NO: 1947 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDFGGTFVFGGGTKLTVL

SEQ ID NO: 1948 - protein, 109 aa, Homo sapiens
QAVVTQEPSLTVSPGGTVTLTCGSSTGTVTIDHYPYWFQQKPGQAPRTLISDTDDKHSWTPARFSGSLLGGKAALTLSGAQPEDEAEYYCLLDYGGRFVFGGGTKLTVL

SEQ ID NO: 1949 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGSFVFGGGTKLTVL

SEQ ID NO: 1950 - protein, 109 aa, Homo sapiens
QAVVTQEPSLTVSPGGTVTLTCGSSTGAVTIWHYPYWFQQKPGQAPRTLISDTNDKHSWTPARFSGSLLGGKAALTLSGAQPEDEAEYYCLLDYGGSFVFGGGTKLTVL

SEQ ID NO: 1951 - protein, 109 aa, Homo sapiens
QAVVTQEPSLTVSPGGTVTLTCGSSTGAVTIDHYPYWFQQKPGQAPRTLISDTIYKESWTPARFAGSLLGGKAALTLSGAQPEDEAEYYCLLDYGGTFVFGGGTKLTVL

SEQ ID NO: 1952 - protein, 109 aa, Homo sapiens
QAVVTQEPSLTVSQGGTVTLTCGSSTGDVTIDHYPYWFQQKPGQAPRTLISDTDDKHSWTPARFSGSLLGGKAALTLSGAQPEDEAEYYCLLDYRGNMVFGGGTKLTVL

SEQ ID NO: 1953 - protein, 109 aa, Homo sapiens
QAVVTQEPSLTVSPGGTVTLTCGSSTGDVTIDHYPYWFQQKPGQAPRTLISDTDDKHSWTPARFSGSLLGGKAALTLSGAQPEDEAEYYCLLDYGGTFVFGGGTKLTVL

SEQ ID NO: 1954 - protein, 109 aa, Homo sapiens
QAVVTQEPSLTVSPGGTVTLTCGSSTGPVTIDHYPYWFQQKPGQAPRTLISDTIDKHSWTPARFSGSLLGGKAALTLSGAQPEDEAEYYCLLDYGGAFVFGGGTKLTVL

SEQ ID NO: 1955 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLFYGGRLVFGGGTKLTVL

SEQ ID NO: 1956 - protein, 109 aa, Homo sapiens
QAVVTQEPSLTVSPGGTVTLTCGSSTGAVTIDHYPYWFQQKPGQAPRTLISDTIDKHSWTPARFSGSLLGGKAALTLSGAQPEDEAEYYCLLFYGGTVVFGGGTKLTVL

SEQ ID NO: 1957 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYDGTFVFGGGTKLTVL

SEQ ID NO: 1958 - protein, 109 aa, Homo sapiens
QAVVTQEPSLTVSPGGTVTLTCGSSTGEVTSEHYPYWFQQKPGQAPRTLISDTIDKHSWTPARFSGSLLGGKAALTLSGAQPEDEAEYYCLLFYGGTLVFGGGTKLTVL

SEQ ID NO: 1959 - protein, 109 aa, Homo sapiens
QAVVTQEPSLTVSPGGTVTLTCGSSTGDVTIDHYPYWFQQKPGQAPRTLISDTDDKHSWTPARFSGSLLGGKAALTLSGAQPEDEAEYYCLLDYRGTMVFGGGTKLTVL

SEQ ID NO: 1960 - protein, 109 aa, Homo sapiens
QAVVTQEPSLTVSPGGTVTLTCGSSTGTVTIDHYPYWFQQKPGQAPRTLISDTDDKHSWTPARFSGSLLGGKAALTLSGAQPEDEAEYYCLLFYGGTVVFGGGTKLTVL

SEQ ID NO: 1961 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLDYNGTFVFGGGTKLTVL

SEQ ID NO: 1962 - protein, 109 aa, Homo sapiens
QAVVTQEPSLTVSPGGTVTLTCGSSTGDVTIDHYPYWFQQKPGQAPRTLISDTNDKHSWTPARFSGSLLGGKAALTLSGAQPEDEAEYYCLLDYGGRFVFGGGTKLTVL

SEQ ID NO: 1963 - protein, 109 aa, Homo sapiens
QAVVTQEPSLTVSPGGTVTLTCGSSTGNVTMWHYPYWFQQKPGQAPRTLISDTDDKHSWTPARFSGSLLGGKAALTLSGAQPEDEAEYYCLLDYGGRFVFGGGTKLTVL

SEQ ID NO: 1964 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLFYGGNLVFGGGTKLTVL

SEQ ID NO: 1965 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLDYGGAFVFGGGTKLTVL

SEQ ID NO: 1966 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLDFGGTFVFGGGTKLTVL

SEQ ID NO: 1967 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLDYGGTFVFGGGTKLTVL

SEQ ID NO: 1968 - protein, 109 aa, Homo sapiens
QAVVTQEPSLTVSPGGTVTLTCGSSTGPVTIDHYPYWFQQKPGQAPRTLISDTNDKHSWTPARFSGSLLGGKAALTLSGAQPEDEAEYYCLLDYGGRFVFGGGTKLTVL

SEQ ID NO: 1969 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLFNGGNVVFGGGTKLTVL

SEQ ID NO: 1970 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLFFGGTVVFGGGTKLTVL

SEQ ID NO: 1971 - protein, 109 aa, Homo sapiens
QAVVTQEPSLTVSPGGTVTLTCGSSTGRVTIDHYPYWFQQKPGQAPRTLISDTNDKHSWTPARFSGSLLGGKAALTLSGAQPEDEAEYYCLLDFGGTFVFGGGTKLTVL

SEQ ID NO: 1972 - protein, 109 aa, Homo sapiens
QAVVTQEPSLTVSPGGTVTLTCGSSTGSVTIDHYPYWFQQKPGQAPRTLISDTDDKHSWTPARFSGSLLGGKAALTLSGAQPEDEAEYYCLLDYEGTFVFGGGTKLTVL

SEQ ID NO: 1973 - protein, 109 aa, Homo sapiens; identical to SEQ ID NO: 1936

SEQ ID NO: 1974 - protein, 109 aa, Homo sapiens
QAVVTQEPSLTVSPGGTVTLTCGSSTGDVTIDHYPYWFQQKPGQAPRTLISDTDDKHSWTPARFSGSLLGGKAALTLSGAQPEDEAEYYCLLFYGGTVVFGGGTKLTVL

SEQ ID NO: 1975 - protein, 109 aa, Homo sapiens
QAVVTQEPSLTVSPGGTVTLTCGSSTGNVTIEHYPYWFQQKPGQAPRTLISDTDDKHSWTPARFSGSLLGGKAALTLSGAQPEDEAEYYCLLFYGGTLVFGGGTKLTVL

SEQ ID NO: 1976 - protein, 109 aa, Homo sapiens
QAVVTQEPSLTVSPGGTVTLTCGSSTGNVTVDHYPYWFQQKPGQAPRTLISDTTDKHSWTPARFSGSLLGGKAALTLSGAQPEDEAEYYCLLDYGGTFVFGGGTKLTVL

SEQ ID NO: 1977 - protein, 109 aa, Homo sapiens
QAVVTQEPSLTVSPGGTVTLTCGSSTGDVTTDHYPYWFQQKPGQAPRTLISDTNDKHSWTPARFSGSLLGGKAALTLSGAQPEDEAEYYCLLFYGGTLVFGGGTKLTVL

SEQ ID NO: 1978 - protein, 109 aa, Homo sapiens
QAVVTQEPSLTVSPGGTVTLTCGSSTGNVTIDHYPYWFQQKPGQAPRTLISDTNDKHSWTPARFSGSLLGGKAALTLSGAQPEDEAEYYCLLDYGGTFVFGGGTKLTVL

SEQ ID NO: 1979 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLDYGGTLVFGGGTKLTVL

SEQ ID NO: 1980 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLDDGGTFVFGGGTKLTVL

SEQ ID NO: 1981 - protein, 109 aa, Homo sapiens
QAVVTQEPSLTVSPGGTVTLTCGSSTGAVTIEHYPYWFQQKPGQAPRTLISDTDDKHSWTPARFSGSLLGGKAALTLSGAQPEDEAEYYCLLDYGGTFVFGGGTKLTVL

SEQ ID NO: 1982 - protein, 109 aa, Homo sapiens
QAVVTQEPSLTVSPGGTVTLTCGSSTGAVTIDHYPYWFQQKPGQAPRTLIFDTIDKHSWTPARFSGSLLGGKAALTLSGAQPEDEAEYYCLLFYGGTVVFGGGTKLTVL

SEQ ID NO: 1983 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGTLVFGGGTKLTVL

SEQ ID NO: 1984 - protein, 109 aa, Homo sapiens
QAVVTQEPSLTVSPGGTVTLTCGSSTGSVTIDHYPYWFQQKPGQAPRTLISDTIDKHSWTPARFSGSLLGGKAALTLSGAQPEDEAEYYCLLDYGGAFVFGGGTKLTVL

SEQ ID NO: 1985 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLDYEGTFVFGGGTKLTVL

SEQ ID NO: 1986 - protein, 109 aa, Homo sapiens
QAVVTQEPSLTVSPGGTVTLTCGSSTGAVTAGHYPYWFQQKPGQAPRTLISDTIDKHSWTPARFSGSLLGGKAALTLSGAQPEDEAEYYCLLDYGGAFVFGGGTKLTVL

SEQ ID NO: 1987 - protein, 109 aa, Homo sapiens
QAVVTQEPSLTVSPGGTVTLTCGSSTGEVTIGHYPYWFQQKPGQAPRTLISDTDDKHSWTPARFSGSLLGGKAALTLSGAQPEDEAEYYCLLDYRGTMVFGGGTKLTVL

SEQ ID NO: 1988 - protein, 109 aa, Homo sapiens
QAVVTQEPSLTVSPGGTVTLTCGSSTGEVTIDHYPYWFQQKPGQAPRTLISDTNDKHSWTPARFSGSLLGGKAALTLSGAQPEDEAEYYCLLDYGGTFVFGGGTKLTVL

SEQ ID NO: 1989 - protein, 109 aa, Homo sapiens; identical to SEQ ID NO: 1891

SEQ ID NO: 1990 - protein, 109 aa, Homo sapiens
QAVVTQEPSLTVSPGGTVTLTCGSSTGAVTIEHYPYWFQQKPGQAPRTLISDTNDKHSWTPARFSGSLLGGKAALTLSGAQPEDEAEYYCLLDFGGTFVFGGGTKLTVL

SEQ ID NO: 1991 - protein, 109 aa, Homo sapiens
QAVVTQEPSLTVSPGGTVTLTCGSSTGDVTIGHYPYWFQQKPGQAPRTLISDTDDKHSWTPARFSGSLLGGKAALTLSGAQPEDEAEYYCLLDYGGTFVFGGGTKLTVL

SEQ ID NO: 1992 - skipped

SEQ ID NO: 1993 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGNFVFGGGTKLTVL

SEQ ID NO: 1994 - protein, 109 aa, Homo sapiens
QAVVTQEPSLTVSPGGTVTLTCGSSTGDVTIDHYPYWFQQKPGQAPRTLISDTDDKPSWTPARFSGSLLGGKAALTLSGAQPEDEAEYYCLLDYGGTFVFGGGTKLTVL

SEQ ID NO: 1995 - protein, 109 aa, Homo sapiens
QAVVTQEPSLTVSPGGTVTLTCGSSTGAVTIDHYPYWFQQKPGQAPRTLISDTNDKHSWTPARFSGSLLGGKAALTLSGAQPEDEAEYYCLLDYGGRFVFGGGTKLTVL

SEQ ID NO: 1996 - protein, 109 aa, Homo sapiens
QAVVTQEPSLTVSPGGTVTLTCGSSTGDVTIEHYPYWFQQKPGQAPRTLISDTDDKHSWTPARFSGSLLGGKAALTLSGAQPEDEAEYYCLLFYGGNVVFGGGTKLTVL

SEQ ID NO: 1997 - protein, 109 aa, Homo sapiens
QAVVTQEPSLTVSPGGTVTLTCGSSTGAVTIDHYPYWFQQKPGQAPRTLISDTDDKHSWTPARFSGSLLGGKAALTLSGAQPEDEAEYYCLLDYGGTVVFGGGTKLTVL

SEQ ID NO: 1998 - protein, 121 aa, Artificial Sequence; identical to SEQ ID NO: 1808
  source: /note="Description of Artificial Sequence: Synthetic polypeptide"

SEQ ID NO: 1999 - protein, 121 aa, Artificial Sequence; identical to SEQ ID NO: 1800
  source: /note="Description of Artificial Sequence: Synthetic polypeptide"

SEQ ID NO: 2000 - protein, 121 aa, Artificial Sequence; identical to SEQ ID NO: 704
  source: /note="Description of Artificial Sequence: Synthetic polypeptide"

SEQ ID NO: 2001 - protein, 121 aa, Artificial Sequence; identical to SEQ ID NO: 1803
  source: /note="Description of Artificial Sequence: Synthetic polypeptide"

SEQ ID NO: 2002 - protein, 121 aa, Artificial Sequence; identical to SEQ ID NO: 1864
  source: /note="Description of Artificial Sequence: Synthetic polypeptide"

SEQ ID NO: 2003 - protein, 121 aa, Artificial Sequence; identical to SEQ ID NO: 1801
  source: /note="Description of Artificial Sequence: Synthetic polypeptide"

SEQ ID NO: 2004 - protein, 121 aa, Artificial Sequence; identical to SEQ ID NO: 644
  source: /note="Description of Artificial Sequence: Synthetic polypeptide"

SEQ ID NO: 2005 - protein, 121 aa, Artificial Sequence; identical to SEQ ID NO: 764
  source: /note="Description of Artificial Sequence: Synthetic polypeptide"

SEQ ID NO: 2006 - protein, 121 aa, Artificial Sequence; identical to SEQ ID NO: 1719
  source: /note="Description of Artificial Sequence: Synthetic polypeptide"

SEQ ID NO: 2007 - protein, 121 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSEGYWEKYFQHWGRGTLVTVSS

SEQ ID NO: 2008 - protein, 109 aa, Artificial Sequence; identical to SEQ ID NO: 1937
  source: /note="Description of Artificial Sequence: Synthetic polypeptide"

SEQ ID NO: 2009 - protein, 109 aa, Artificial Sequence; identical to SEQ ID NO: 1950
  source: /note="Description of Artificial Sequence: Synthetic polypeptide"

SEQ ID NO: 2010 - protein, 109 aa, Artificial Sequence; identical to SEQ ID NO: 1937
  source: /note="Description of Artificial Sequence: Synthetic polypeptide"

SEQ ID NO: 2011 - protein, 109 aa, Artificial Sequence; identical to SEQ ID NO: 1945
  source: /note="Description of Artificial Sequence: Synthetic polypeptide"

SEQ ID NO: 2012 - protein, 109 aa, Artificial Sequence; identical to SEQ ID NO: 1960
  source: /note="Description of Artificial Sequence: Synthetic polypeptide"

SEQ ID NO: 2013 - protein, 109 aa, Artificial Sequence; identical to SEQ ID NO: 1937
  source: /note="Description of Artificial Sequence: Synthetic polypeptide"

SEQ ID NO: 2014 - protein, 109 aa, Artificial Sequence; identical to SEQ ID NO: 1948
  source: /note="Description of Artificial Sequence: Synthetic polypeptide"

SEQ ID NO: 2015 - protein, 109 aa, Artificial Sequence; identical to SEQ ID NO: 1949
  source: /note="Description of Artificial Sequence: Synthetic polypeptide"

SEQ ID NO: 2016 - protein, 109 aa, Artificial Sequence; identical to SEQ ID NO: 2
  source: /note="Description of Artificial Sequence: Synthetic polypeptide"

SEQ ID NO: 2017 - protein, 109 aa, Artificial Sequence; identical to SEQ ID NO: 1870
  source: /note="Description of Artificial Sequence: Synthetic polypeptide"

SEQ ID NO: 2018 - protein, 119 aa, Homo sapiens; identical to SEQ ID NO: 3

SEQ ID NO: 2019 - protein, 111 aa, Homo sapiens
QSGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGGGTKLTVL

SEQ ID NO: 2020 - protein, 119 aa, Homo sapiens; identical to SEQ ID NO: 794

SEQ ID NO: 2021 - protein, 119 aa, Homo sapiens; identical to SEQ ID NO: 844

SEQ ID NO: 2022 - protein, 119 aa, Homo sapiens; identical to SEQ ID NO: 894

SEQ ID NO: 2023 - protein, 119 aa, Homo sapiens; identical to SEQ ID NO: 944

SEQ ID NO: 2024 - protein, 119 aa, Homo sapiens
EVQLVESGGGLVQPGRSLRLSCAASGFTFDDYALHWVRQAPGKGLEWVSGISWHGDFIDYADSVKGRFTISRDNAKNSLYLQMNSLRVEDTALYYCAGNNRGYGGLDVWGQGTTVTVSS

SEQ ID NO: 2025 - protein, 119 aa, Homo sapiens
EVQLVESGGGLVQPGRSLRLSCAASGFTFDQYALHWVRQAPGKGLEWVSGINWDGDYIDYADSVKGRFTISRDNAKNSLYLQMNSLRVEDTALYYCAGNIRGYGGLDVWGQGTTVTVSS

SEQ ID NO: 2026 - protein, 119 aa, Homo sapiens
EVQLVESGGGLVQPGRSLRLSCAASGFTFEDYALHWVRQAPGKGLEWVSGIGWNDDEIDYADSVKGRFTISRDNSKNSLYLQMNSLRVEDTALYYCAGNNRGYGGLDVWGQGTTVTVSS

SEQ ID NO: 2027 - protein, 119 aa, Homo sapiens
EVQLVESGGGLVQPGRSLRLSCAASGFTFEDYALHWVRQAPGKGLEWVSGIGWDRDFIDYADSVKGRFTISRDNAKNSLYLQMNSLRVEDTALYYCAGNKIGYGGLDVWGQGTTVTVSS

SEQ ID NO: 2028 - protein, 119 aa, Homo sapiens
EVQLVESGGGLVQPGRSLRLSCAASGFTFDDYALHWVRQAPGKGLEWVSGIGWDDDMIDYADSVKGRFTISRDNAKNSLYLQMNSLRVEDTALYYCAGNNRGYGGLDVWGQGTTVTVSS

SEQ ID NO: 2029 - protein, 119 aa, Homo sapiens
EVQLVESGGGLVQPGRSLRLSCAASGFTFSDYALHWVRQAPGKGLEWVSGISWYGDDIDYADSVKGRFTISRDNAKNSLYLQMNSLRVEDTALYYCAGNIRGYGGLDVWGQGTTVTVSS

SEQ ID NO: 2030 - protein, 119 aa, Homo sapiens; identical to SEQ ID NO: 2024

SEQ ID NO: 2031 - protein, 119 aa, Homo sapiens; identical to SEQ ID NO: 794

SEQ ID NO: 2032 - protein, 119 aa, Homo sapiens; identical to SEQ ID NO: 844

SEQ ID NO: 2033 - protein, 119 aa, Homo sapiens; identical to SEQ ID NO: 894

SEQ ID NO: 2034 - protein, 119 aa, Homo sapiens; identical to SEQ ID NO: 944

SEQ ID NO: 2035 - protein, 110 aa, Homo sapiens
QSVLTQPPSASGTPGQRVTISCSGSSSNIGRNTVNWYQQLPGTAPKLLIYSNNQRPSGVPDRFSGSKSGTSASLAISGLQSEDEADYYCAAWDDNLESYVFGGGTKLTVL

SEQ ID NO: 2036 - protein, 111 aa, Homo sapiens
QSVLTQPPSASGTPGQRVTISCSGSSSNIGGNTVNWYQQLPGTAPKLLIYSNNQRPSGVPDRFSGSKSGTSASLAISGLQSEDEADYYCAAWDDSLEGSYVFGGGTKLTVL

SEQ ID NO: 2037 - protein, 111 aa, Homo sapiens
QSVLTQPPSASGTPGQRVTISCSGSWSNIGSNTVNWYQQLPGTAPKLLIYNNNQRPSGVPDRFSGSKSGTSASLAISGLQSEDEADYYCAAWDDSLSGEYVFGGGTKLTVL

SEQ ID NO: 2038 - protein, 110 aa, Homo sapiens
QSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLDSYVFGGGTKLTVL

SEQ ID NO: 2039 - protein, 111 aa, Homo sapiens
QSVLTQPPSASGTPGQRVTISCSGSWSNIGGNTVNWYQQLPGTAPKLLIYNNNQRPSGVPDRFSGSKSGTSASLAISGLQSEDEADYYCAAWDDTLEGSYVFGGGTKLTVL

SEQ ID NO: 2040 - protein, 111 aa, Homo sapiens
QSVLTQPPSASGTPGQRVTISCSGSWSNIGGNTVNWYQQLPGTAPKLLIYNNNQRPSGVPDRFSGSKSGTSASLAISGLQSEDEADYYCAAWDDSLDGEYVFGGGTKLTVL

SEQ ID NO: 2041 - protein, 110 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDELELYVFGGGTKLTVL

SEQ ID NO: 2042 - protein, 110 aa, Homo sapiens
QSVLTQPPSASGTPGQRVTISCSGSSSNIGTNTVNWYQQLPGTAPKLLIYSNNQRPSGVPDRFSGSKSGTSASLAISGLQSEDEADYYCAAWDDQLEAYVFGGGTKLTVL

SEQ ID NO: 2043 - protein, 110 aa, Homo sapiens
QSVLTQPPSASGTPGQRVTISCSGSSSNIGTNTVNWYQQLPGTAPKLLIYSNNQRPSGVPDRFSGSKSGTSASLAISGLQSEDEADYYCAAWDDRLDEYVFGGGTKLTVL

SEQ ID NO: 2044 - protein, 111 aa, Homo sapiens
QSVLTQPPSASGTPGQRVTISCSGSWSNIGSNTVNWYQQLPGTAPKLLIYSNNQRPSGVPDRFSGSKSGTSASLAISGLQSEDEADYYCAAWDDSLDGAYVFGGGTKLTVL

SEQ ID NO: 2045 - protein, 110 aa, Homo sapiens
QSVLTQPPSASGTPGQRVTISCSGSSSNIGGNTVNWYQQLPGTAPKLLIYSNNQRPSGVPDRFSGSKSGTSASLAISGLQSEDEADYYCAAWDDILESYVFGGGTKLTVL

SEQ ID NO: 2046 - protein, 111 aa, Homo sapiens; identical to SEQ ID NO: 799

SEQ ID NO: 2047 - protein, 112 aa, Homo sapiens; identical to SEQ ID NO: 849

SEQ ID NO: 2048 - protein, 112 aa, Homo sapiens; identical to SEQ ID NO: 899

SEQ ID NO: 2049 - protein, 111 aa, Homo sapiens; identical to SEQ ID NO: 949

SEQ ID NO: 2050 - protein, 12 aa, Artificial Sequence
  source: /note="Description of Artificial Sequence: Synthetic peptide"
ADAAPTVSIFPP

SEQ ID NO: 2051 - protein, 6 aa, Artificial Sequence
  source: /note="Description of Artificial Sequence: Synthetic peptide"
QPKAAP

SEQ ID NO: 2052 - protein, 13 aa, Artificial Sequence
  source: /note="Description of Artificial Sequence: Synthetic peptide"
QPKAAPSVTLFPP

SEQ ID NO: 2053 - protein, 6 aa, Artificial Sequence
  source: /note="Description of Artificial Sequence: Synthetic peptide"
AKTTPP

SEQ ID NO: 2054 - protein, 13 aa, Artificial Sequence
  source: /note="Description of Artificial Sequence: Synthetic peptide"
AKTTPPSVTPLAP

SEQ ID NO: 2055 - protein, 6 aa, Artificial Sequence
  source: /note="Description of Artificial Sequence: Synthetic peptide"
AKTTAP

SEQ ID NO: 2056 - protein, 13 aa, Artificial Sequence
  source: /note="Description of Artificial Sequence: Synthetic peptide"
AKTTAPSVYPLAP

SEQ ID NO: 2057 - protein, 15 aa, Artificial Sequence
  source: /note="Description of Artificial Sequence: Synthetic peptide"
GENKVEYAPALMALS

SEQ ID NO: 2058 - protein, 15 aa, Artificial Sequence
  source: /note="Description of Artificial Sequence: Synthetic peptide"
GPAKELTPLKEAKVS

SEQ ID NO: 2059 - protein, 15 aa, Artificial Sequence
  source: /note="Description of Artificial Sequence: Synthetic peptide"
GHEAAAVMQVQYPAS

SEQ ID NO: 2060 - protein, 330 aa, Homo sapiens
ASTKGPSVFFLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2061 - protein, 330 aa, Homo sapiens; identical to SEQ ID NO: 725

SEQ ID NO: 2062 - protein, 330 aa, Homo sapiens; identical to SEQ ID NO: 25

SEQ ID NO: 2063 - protein, 330 aa, Homo sapiens; identical to SEQ ID NO: 685

SEQ ID NO: 2064 - protein, 106 aa, Homo sapiens; identical to SEQ ID NO: 40

SEQ ID NO: 2065 - protein, 105 aa, Homo sapiens; identical to SEQ ID NO: 30

SEQ ID NO: 2066 - protein, 121 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTNTEDTSTDTAYMELSSLRSEDTAVYYCATDSEGYWEKYFQHWGRGTLVTVSS

SEQ ID NO: 2067 - protein, 119 aa, Artificial Sequence; identical to SEQ ID NO: 3
  source: /note="Description of Artificial Sequence: Synthetic polypeptide"

SEQ ID NO: 2068 - protein, 119 aa, Artificial Sequence; identical to SEQ ID NO: 794
  source: /note="Description of Artificial Sequence: Synthetic polypeptide"

SEQ ID NO: 2069 - protein, 119 aa, Artificial Sequence; identical to SEQ ID NO: 2025
  source: /note="Description of Artificial Sequence: Synthetic polypeptide"

SEQ ID NO: 2070 - protein, 119 aa, Artificial Sequence; identical to SEQ ID NO: 2029
  source: /note="Description of Artificial Sequence: Synthetic polypeptide"

SEQ ID NO: 2071 - protein, 119 aa, Artificial Sequence; identical to SEQ ID NO: 2024
  source: /note="Description of Artificial Sequence: Synthetic polypeptide"

SEQ ID NO: 2072 - protein, 119 aa, Artificial Sequence; identical to SEQ ID NO: 2024
  source: /note="Description of Artificial Sequence: Synthetic polypeptide"

SEQ ID NO: 2073 - protein, 119 aa, Artificial Sequence; identical to SEQ ID NO: 2026
  source: /note="Description of Artificial Sequence: Synthetic polypeptide"

SEQ ID NO: 2074 - protein, 119 aa, Artificial Sequence; identical to SEQ ID NO: 844
  source: /note="Description of Artificial Sequence: Synthetic polypeptide"

SEQ ID NO: 2075 - protein, 119 aa, Artificial Sequence; identical to SEQ ID NO: 894
  source: /note="Description of Artificial Sequence: Synthetic polypeptide"

SEQ ID NO: 2076 - protein, 119 aa, Artificial Sequence; identical to SEQ ID NO: 2028
  source: /note="Description of Artificial Sequence: Synthetic polypeptide"

SEQ ID NO: 2077 - protein, 119 aa, Artificial Sequence; identical to SEQ ID NO: 944
  source: /note="Description of Artificial Sequence: Synthetic polypeptide"

SEQ ID NO: 2078 - protein, 119 aa, Artificial Sequence; identical to SEQ ID NO: 2027
  source: /note="Description of Artificial Sequence: Synthetic polypeptide"

SEQ ID NO: 2079 - protein, 121 aa, Artificial Sequence
  source: /note="Description of Artificial Sequence: Synthetic polypeptide"
  VARIANT (52)..(52): /replace="Ser" or "Asn" or "Gly"
  misc_feature (52)..(52): /note="Residue given in the sequence has no preference with respect to those in the annotations for said position"
  VARIANT (55)..(55): /replace="Gly" or "Glu" or "Arg"
  misc_feature (55)..(55): /note="Residue given in the sequence has no preference with respect to those in the annotations for said position"
  VARIANT (57)..(57): /replace="Phe" or "Asp" or "Tyr" or "Glu" or "Met"
  misc_feature (57)..(57): /note="Residue given in the sequence has no preference with respect to those in the annotations for said position"
  VARIANT (106)..(107): /replace=" "
  misc_feature (106)..(107): /note="Residues given in the sequence have no preference with respect to those in the annotations for said positions"
EVQLVESGGGLVQPGRSLRLSCAASGFTFDDYALHWVRQAPGKGLEWVSGIDWDDDEIDYADSVKGRFTISRDNAKNSLYLQMNSLRVEDTALYYCAGNNRGYGGKYLDVWGQGTTVTVSS

SEQ ID NO: 2080 - protein, 109 aa, Artificial Sequence
  source: /note="Description of Artificial Sequence: Synthetic polypeptide"
QTVVTQEPSLTVSPGGTVTLTCGSSTGAVTSGHYPYWFQQKPGQAPRTLISDTNDKHSWTPARFSGSLLGGKAALTLSGAQPEDEAEYYCLLFYGGTVVFGGGTKLTVL

SEQ ID NO: 2081 - protein, 111 aa, Artificial Sequence; identical to SEQ ID NO: 2039
  source: /note="Description of Artificial Sequence: Synthetic polypeptide"

SEQ ID NO: 2082 - protein, 110 aa, Artificial Sequence; identical to SEQ ID NO: 2045
  source: /note="Description of Artificial Sequence: Synthetic polypeptide"

SEQ ID NO: 2083 - protein, 111 aa, Artificial Sequence; identical to SEQ ID NO: 2036
  source: /note="Description of Artificial Sequence: Synthetic polypeptide"

SEQ ID NO: 2084 - protein, 110 aa, Artificial Sequence; identical to SEQ ID NO: 2035
  source: /note="Description of Artificial Sequence: Synthetic polypeptide"

SEQ ID NO: 2085 - protein, 111 aa, Artificial Sequence; identical to SEQ ID NO: 2044
  source: /note="Description of Artificial Sequence: Synthetic polypeptide"

SEQ ID NO: 2086 - protein, 111 aa, Artificial Sequence; identical to SEQ ID NO: 2037
  source: /note="Description of Artificial Sequence: Synthetic polypeptide"

SEQ ID NO: 2087 - protein, 111 aa, Artificial Sequence; identical to SEQ ID NO: 2040
  source: /note="Description of Artificial Sequence: Synthetic polypeptide"

SEQ ID NO: 2088 - protein, 110 aa, Artificial Sequence; identical to SEQ ID NO: 2038
  source: /note="Description of Artificial Sequence: Synthetic polypeptide"

SEQ ID NO: 2089 - protein, 111 aa, Artificial Sequence; identical to SEQ ID NO: 2019
  source: /note="Description of Artificial Sequence: Synthetic polypeptide"

SEQ ID NO: 2090 - protein, 110 aa, Artificial Sequence; identical to SEQ ID NO: 2041
  source: /note="Description of Artificial Sequence: Synthetic polypeptide"

SEQ ID NO: 2091 - protein, 110 aa, Artificial Sequence; identical to SEQ ID NO: 2042
  source: /note="Description of Artificial Sequence: Synthetic polypeptide"

SEQ ID NO: 2092 - protein, 110 aa, Artificial Sequence; identical to SEQ ID NO: 2043
  source: /note="Description of Artificial Sequence: Synthetic polypeptide"

SEQ ID NO: 2093 - protein, 111 aa, Artificial Sequence
  source: /note="Description of Artificial Sequence: Synthetic polypeptide"
  VARIANT (27)..(27): /replace=" "
  misc_feature (27)..(27): /note="Residue given in the sequence has no preference with respect to the annotation for said position"
  VARIANT (98)..(98): /replace=" "
  misc_feature (98)..(98): /note="Residue given in the sequence has no preference with respect to the annotation for said position"
QSVLTQPPSASGTPGQRVTISCSGSSGSNIGSNTVNWYQQLPGTAPKLLIYSNNQRPSGVPDRFSGSKSGTSASLAISGLQSEDEADYYCAAWDDSLGSYVFGGGTKLTVL

What is claimed is:

1. A binding protein comprising an antigen binding domain capable of binding human sclerostin, the antigen binding domain comprising three CDRs in a heavy chain and three CDRs in a light chain,
wherein the heavy chain comprises a CDR-H1, a CDR-H2 and a CDR-H3;
wherein the CDR-H1 comprises the amino acid sequence of $X_1$-L-S-$X_2$-H (residues 31-35 of SEQ ID NO: 1);
wherein $X_1$ is E or G; and
wherein $X_2$ is M, V or L;
wherein the CDR-H2 comprises the amino acid sequence of G-$X_3$-$X_4$-P-E-$X_5$-G-E-$X_6$-I-Y-A-Q-K-F-Q-G (residues 50-66 of SEQ ID NO: 1);
wherein $X_3$ is F or S;
wherein $X_4$ is D or N;
wherein $X_5$ is D, E, V, Y, N, G, A, R, Q, H, F or I; and
wherein $X_6$ is T, I, L, M or N; and
the CDR-H3 comprises the amino acid sequence of $X_7$-$X_8$-$X_9$-$X_{10}$-$X_{11}$-W-$X_{12}$-$X_{13}$-$X_{14}$-F-Q-H (residues 99-110 of SEQ ID NO: 1);
wherein $X_7$ is D or E;
wherein $X_8$ is S, T or A;
wherein $X_9$ is E, D, V, A, L, Y, W, Q, N, M, or G;
wherein $X_{10}$ is G or S;
wherein $X_{11}$ is Y, F, R, N, V, S, P or I;
wherein $X_{12}$ is E, Y, F or V;
wherein $X_{13}$ is K, Q or I; and
wherein $X_{14}$ is Y or F, and
wherein the light chain comprises a CDR-L1, a CDR-L2 and a CDR-L3;
wherein the CDR-L1 comprises an amino acid sequence of G-S-S-T-G-$X_{15}$ V-T-$X_{16}$-$X_{17}$-H-Y-$X_{18}$-Y (residues 23-36 of SEQ ID NO: 2),
wherein $X_{15}$ is A, D, P, G, S, N E, T or H;
wherein $X_{16}$ is S, I, V, T, G or M;
wherein $X_{17}$ is G, E, D, W, Y or N; and
wherein $X_{18}$ is P or T;
wherein the CDR-L2 comprises the amino acid sequence of D-T-$X_{19}$-$X_{20}$-K-$X_{21}$-S (residues 52-58 of SEQ ID NO: 2),
wherein $X_{19}$ is N, D, I, R, V, or T;
wherein $X_{20}$ is D or E; and
wherein $X_{21}$ is H, Q, N or D; and
wherein the CDR-L3 comprises the amino acid sequence of L-L-$X_{22}$-$X_{23}$-$X_{24}$$X_{-25}$-$X_{26}$-$X_{27}$-V (residues 91-99 of SEQ ID NO: 2);
wherein $X_{22}$ is F or D;
wherein $X_{23}$ is Y, D, F, or N;
wherein $X_{24}$ is G or R;
wherein $X_{25}$ is G or S;
wherein $X_{26}$ is T, S, N or R; and
wherein $X_{27}$ is V, L, M or F.

2. The binding protein of claim 1, wherein at least one CDR comprises an amino acid sequence selected from the group consisting of Residues 31-35 of SEQ ID NO:1998; Residues 50-66 of SEQ ID NO:1998; Residues 99-110 of SEQ ID NO:1998; Residues 31-35 of SEQ ID NO.:1999; Residues 50-66 of SEQ ID NO.:1999; Residues 99-110 of SEQ ID NO.:1999; Residues 31-35 of SEQ ID NO.:2000; Residues 50-66 of SEQ ID NO.:2000; Residues 99-110 of SEQ ID NO.:2000; Residues 31-35 of SEQ ID NO.:2001; Residues 50-66 of SEQ ID NO.:2001; Residues 99-110 of SEQ ID NO.:2001; Residues 31-35 of SEQ ID NO.:2002; Residues 50-66 of SEQ ID NO.:2002; Residues 99-110 of SEQ ID NO.:2002; Residues 31-35 of SEQ ID NO.:2003; Residues 50-66 of SEQ ID NO.:2003; Residues 99-110 of SEQ ID NO.:2003; Residues 31-35 of SEQ ID NO.:2004; Residues 50-66 of SEQ ID NO.:2004; Residues 99-110 of SEQ ID NO.:2004; Residues 31-35 of SEQ ID NO.:2005; Residues 50-66 of SEQ ID NO.:2005; Residues 99-110 of SEQ ID NO.:2005; Residues 31-35 of SEQ ID NO.:2006; Residues 50-66 of SEQ ID NO.:2006; Residues 99-110 of SEQ ID NO.:2006; Residues 31-35 of SEQ ID NO.:2007; Residues 50-66 of SEQ ID NO.:2007; Residues 99-110 of SEQ ID NO.:2007; Residues 23-36 of SEQ ID NO.:2008; Residues 52-58 of SEQ ID NO.:2008; Residues 91-99 of SEQ ID NO.:2008; Residues 23-36 of SEQ ID NO.:2009; Residues 52-58 of SEQ ID NO.:2009; Residues 91-99 of SEQ ID NO.:2009; Residues 23-36 of SEQ ID NO.:2010; Residues 52-58 of SEQ ID NO.:2010; Residues 91-99 of SEQ ID NO.:2010; Residues 23-36 of SEQ ID NO.:2011; Residues 52-58 of SEQ ID NO.:2011; Residues 91-99 of SEQ ID NO.:2011; Residues 23-36 of SEQ ID NO.:2012; Residues 52-58 of SEQ ID NO.:2012; Residues 91-99 of SEQ ID NO.:2012; Residues 23-36 of SEQ ID NO.:2013; Residues 52-58 of SEQ ID NO.:2013; Residues 91-99 of SEQ ID NO.:2013; Residues 23-36 of SEQ ID NO.:2014; Residues 52-58 of SEQ ID NO.:2014; Residues 91-99 of SEQ ID NO.:2014; Residues 23-36 of SEQ ID NO.:2015; Residues 52-58 of SEQ ID NO.:2015; Residues 91-99 of SEQ ID NO.:2015; Residues 23-36 of SEQ ID NO.:2016; Residues 52-58 of SEQ ID NO.:2016; Residues 91-99 of SEQ ID NO.:2016; Residues 23-36 of SEQ ID NO.:2017; Residues 52-58 of SEQ ID NO.:2017; Residues 91-99 of SEQ ID NO.:2017.

3. The binding protein of claim 1, wherein the antigen binding domain comprises a variable domain CDR set selected from the group consisting of:

| VH AE10-6 AM1 CDR Set | |
|---|---|
| VH AE10-6 AM1 CDR-H1 | Residues 31-35 of SEQ ID NO: 1998 |
| VH AE10-6 AM1 CDR-H2 | Residues 50-66 of SEQ ID NO: 1998 |
| VH AE10-6 AM1 CDR-H3 | Residue 99-110 of SEQ ID NO: 1998 |
| VL AE10-6 AM1 Set | |
| VL AE10-6 AM1 CDR-L1 | Residues 23-36 of SEQ ID NO: 2008 |
| VL AE10-6 AM1 CDR-L2 | Residues 52-58 of SEQ ID NO: 2008 |
| VL AE10-6 AM1 CDR-L3 | Residues 91-99 of SEQ ID NO: 2008 |
| VH AE10-6 AM2 CDR Set | |
| VH AE10-6 AM2 CDR-H1 | Residues 31-35 of SEQ ID NO: 1999 |
| VH AE10-6 AM2 CDR-H2 | Residues 50-66 of SEQ ID NO: 1999 |
| VH AE10-6 AM2 CDR-H3 | Residue 99-110 of SEQ ID NO: 1999 |
| VL AE10-6 AM2 Set | |
| VL AE10-6 AM2 CDR-L1 | Residues 23-36 of SEQ ID NO: 2009 |
| VL AE10-6 AM2 CDR-L2 | Residues 52-58 of SEQ ID NO: 2009 |
| VL AE10-6 AM2 CDR-L3 | Residues 91-99 of SEQ ID NO: 2009 |
| VH AE10-6 AM3 CDR Set | |
| VH AE10-6 AM3 CDR-H1 | Residues 31-35 of SEQ ID NO: 2000 |
| VH AE10-6 AM3 CDR-H2 | Residues 50-66 of SEQ ID NO: 2000 |
| VH AE10-6 AM3 CDR-H3 | Residue 99-110 of SEQ ID NO: 2000 |
| VL AE10-6 AM3 Set | |
| VL AE10-6 AM3 CDR-L1 | Residues 23-36 of SEQ ID NO: 2010 |
| VL AE10-6 AM3 CDR-L2 | Residues 52-58 of SEQ ID NO: 2010 |
| VL AE10-6 AM3 CDR-L3 | Residues 91-99 of SEQ ID NO: 2010 |
| VH AE10-6 AM4 CDR Set | |
| VH AE10-6 AM4 CDR-H1 | Residues 31-35 of SEQ ID NO: 2001 |
| VH AE10-6 AM4 CDR-H2 | Residues 50-66 of SEQ ID NO: 2001 |
| VH AE10-6 AM4 CDR-H3 | Residue 99-110 of SEQ ID NO: 2001 |
| VL AE10-6 AM4 Set | |
| VL AE10-6 AM4 CDR-L1 | Residues 23-36 of SEQ ID NO: 2011 |
| VL AE10-6 AM4 CDR-L2 | Residues 52-58 of SEQ ID NO: 2011 |
| VL AE10-6 AM4 CDR-L3 | Residues 91-99 of SEQ ID NO: 2011 |
| VH AE10-6 AM5 CDR Set | |
| VH AE10-6 AM5 CDR-H1 | Residues 31-35 of SEQ ID NO: 2002 |
| VH AE10-6 AM5 CDR-H2 | Residues 50-66 of SEQ ID NO: 2002 |
| VH AE10-6 AM5 CDR-H3 | Residue 99-110 of SEQ ID NO: 2002 |
| VL AE10-6 AM5 Set | |
| VL AE10-6 AM5 CDR-L1 | Residues 23-36 of SEQ ID NO: 2012 |
| VL AE10-6 AM5 CDR-L2 | Residues 52-58 of SEQ ID NO: 2012 |
| VL AE10-6 AM5 CDR-L3 | Residues 91-99 of SEQ ID NO: 2012 |
| VH AE10-6 AM6 CDR Set | |
| VH AE10-6 AM6 CDR-H1 | Residues 31-35 of SEQ ID NO: 2003 |
| VH AE10-6 AM6 CDR-H2 | Residues 50-66 of SEQ ID NO: 2003 |
| VH AE10-6 AM6 CDR-H3 | Residue 99-110 of SEQ ID NO: 2003 |
| VL AE10-6 AM6 Set | |
| VL AE10-6 AM6 CDR-L1 | Residues 23-36 of SEQ ID NO: 2013 |
| VL AE10-6 AM6 CDR-L2 | Residues 52-58 of SEQ ID NO: 2013 |
| VL AE10-6 AM6 CDR-L3 | Residues 91-99 of SEQ ID NO: 2013 |
| VH AE10-6 AM7 CDR Set | |
| VH AE10-6 AM7 CDR-H1 | Residues 31-35 of SEQ ID NO: 2004 |
| VH AE10-6 AM7 CDR-H2 | Residues 50-66 of SEQ ID NO: 2004 |
| VH AE10-6 AM7 CDR-H3 | Residue 99-110 of SEQ ID NO: 2004 |
| VL AE10-6 AM7 Set | |
| VL AE10-6 AM7 CDR-L1 | Residues 23-36 of SEQ ID NO: 2014 |
| VL AE10-6 AM7 CDR-L2 | Residues 52-58 of SEQ ID NO: 2014 |
| VL AE10-6 AM7 CDR-L3 | Residues 91-99 of SEQ ID NO: 2014 |
| VH AE10-6 AM8 CDR Set | |
| VH AE10-6 AM8 CDR-H1 | Residues 31-35 of SEQ ID NO: 2005 |
| VH AE10-6 AM8 CDR-H2 | Residues 50-66 of SEQ ID NO: 2005 |
| VH AE10-6 AM8 CDR-H3 | Residue 99-110 of SEQ ID NO: 2005 |
| VL AE10-6 AM8 Set | |
| VL AE10-6 AM8 CDR-L1 | Residues 23-36 of SEQ ID NO: 2015 |
| VL AE10-6 AM8 CDR-L2 | Residues 52-58 of SEQ ID NO: 2015 |
| VL AE10-6 AM8 CDR-L3 | Residues 91-99 of SEQ ID NO: 2015 |
| VH AE10-6 AM9 CDR Set | |
| VH AE10-6 AM9 CDR-H1 | Residues 31-35 of SEQ ID NO: 2006 |
| VH AE10-6 AM9 CDR-H2 | Residues 50-66 of SEQ ID NO: 2006 |
| VH AE10-6 AM9 CDR-H3 | Residue 99-110 of SEQ ID NO: 2006 |
| VL AE10-6 AM9 Set | |
| VL AE10-6 AM9 CDR-L1 | Residues 23-36 of SEQ ID NO: 2016 |
| VL AE10-6 AM9 CDR-L2 | Residues 52-58 of SEQ ID NO: 2016 |
| VL AE10-6 AM9 CDR-L3 | Residues 91-99 of SEQ ID NO: 2016 |
| VH AE10-6 AM10 CDR Set | |
| VH AE10-6 AM10 CDR-H1 | Residues 31-35 of SEQ ID NO: 2007 |
| VH AE10-6 AM10 CDR-H2 | Residues 50-66 of SEQ ID NO: 2007 |
| VH AE10-6 AM10 CDR-H3 | Residue 99-110 of SEQ ID NO: 2007 |
| VL AE10-6 AM10 Set | |
| VL AE10-6 AM10 CDR-L1 | Residues 23-36 of SEQ ID NO: 2017 |
| VL AE10-6 AM10 CDR-L2 | Residues 52-58 of SEQ ID NO: 2017 |
| VL AE10-6 AM10 CDR-L3 | Residues 91-99 of SEQ ID NO: 2017. |

4. The binding protein of claim 3, comprising at least two variable domain CDR sets.

5. The binding protein of claim 4, wherein the at least two variable domain CDR sets are selected from the group consisting of VH AE10-6 AM1 CDR Set and VL AE10-6 AM1 CDR Set; VH AE10-6 AM2 CDR Set and VL AE10-6 AM2 CDR Set; VH AE10-6 AM3 CDR Set and VL AE10-6 AM3 CDR Set; VH AE10-6 AM4 CDR Set and VL AE10-6 AM4 CDR Set; VH AE10-6 AM5 CDR Set and VL AE10-6 AM5CDR Set; VH AE10-6 AM6 CDR Set and VL AE10-6 AM6 CDR Set; VH AE10-6 AM7 CDR Set and VL AE10-6 AM7 CDR Set; VH AE10-6 AM8 CDR Set and VL AE10-6AM8_CDR Set; VH AE10-6 AM9_CDR Set and VL AE10-6 AM9CDR Set; VH AE10-6 AM10_CDR Set and VL AE10-6 AM10 CDR Set.

6. The binding protein of claim 1, wherein the binding protein comprises at least one variable domain having an amino acid sequence selected from the group consisting of SEQ ID NOs 1719-1866; SEQ ID NOs1867-1997; SEQ ID NOs 1998-2007; and SEQ ID NOs 2008-2017.

7. The binding protein of claim 1, wherein the binding protein comprises two variable domains, wherein the first variable domain comprises a sequence selected from the group consisting of SEQ ID NOs 1719-1866, and 1998-2007 and wherein the second variable domain comprises a sequence selected from the group consisting of SEQ ID NOs 1867-1997, and 2007-2017.

8. The binding protein of claim 1, wherein the binding protein:
(a) is capable of modulating a biological function of sclerostin;

(b) is capable of neutralizing sclerostin;
(c) wherein the sclerostin is pro-human sclerostin; mature-human sclerostin, or truncated-human sclerostin;
(d) wherein the binding protein diminishes the ability of sclerostin to bind to its receptor; and/or
(e) wherein the neutralizing binding protein is capable of reducing one or more of Th1 modulation; Th2 modulation; Nk modulation; neutrophil modulation; monocyte-macrophage lineage modulation; neutrophil modulation; eosinophil modulation; B-cells modulation; cytokine modulation; chemokine modulation; adhesion molecule modulation; and cell recruitment modulation.

9. A pharmaceutical composition comprising the binding protein of claim 1, and a pharmaceutically acceptable carrier.

10. The pharmaceutical composition of claim 9, further comprising at least one additional therapeutic agent for treating a disorder in which sclerostin activity is detrimental.

11. The pharmaceutical composition of claim 10, wherein the additional agent is selected from the group consisting of a therapeutic agent, imaging agent, cytotoxic agent, angiogenesis inhibitors; kinase inhibitors; co-stimulation molecule blockers; adhesion molecule blockers; anti-cytokine antibody or functional fragment thereof; methotrexate; cyclosporin; rapamycin; FK506; detectable label or reporter; a TNF antagonist; an anti-rheumatic; a muscle relaxant, a narcotic, a non-steroid anti-inflammatory drug (NSAID), an analgesic, an anesthetic, a sedative, a local anesthetic, a neuromuscular blocker, an antimicrobial, an antipsoriatic, a corticosteroid, an anabolic steroid, an erythropoietin, an immunization, an immunoglobulin, an immunosuppressive, a growth hormone, a hormone replacement drug, a radiopharmaceutical, an antidepressant, an antipsychotic, a stimulant, an asthma medication, a beta agonist, an inhaled steroid, an oral steroid, an epinephrine or analog, a cytokine, and a cytokine antagonist.

12. The binding protein of claim 1, wherein the antigen binding domain comprises a heavy chain variable region (VH) comprising three CDRs of SEQ ID NO:2004.

13. The binding protein of claim 1, wherein the antigen binding domain comprises a light chain variable region (VL) comprising three CDRs of SEQ ID NO:2014.

14. The binding protein of claim 1, wherein the antigen binding domain comprises a heavy chain variable region (VH) comprising three CDRs from SEQ ID NO:2004; and wherein the antigen binding domain comprises a light chain variable region (VL) comprising three CDRs of SEQ ID NO:2014.

15. The binding protein of claim 1, wherein the antigen binding domain comprises a heavy chain variable region (VH) comprising the amino acid sequence of SEQ ID NO:2004.

16. The binding protein of claim 1, wherein the antigen binding domain comprises a light chain variable region (VL) comprising the amino acid sequence of SEQ ID NO:2014.

17. The binding protein of claim 1, wherein the antigen binding domain comprises a heavy chain variable region (VH) comprising the amino acid sequence of SEQ ID NO:2004; and wherein the antigen binding domain comprises a light chain variable region (VL) comprising the amino acid sequence of SEQ ID NO:2014.

* * * * *